US010640779B2

(12) United States Patent
Cogan et al.

(10) Patent No.: US 10,640,779 B2
(45) Date of Patent: May 5, 2020

(54) ENGINEERED TRANSGENE INTEGRATION PLATFORM (ETIP) FOR GENE TARGETING AND TRAIT STACKING

(71) Applicant: Dow AgroSciences LLC, Indianapolis, IN (US)

(72) Inventors: Noel Cogan, Macleod (AU); John Forster, Diamond Creek (AU); Matthew Hayden, Templestowe (AU); Tim Sawbridge, Coburg (AU); German Spangenberg, Bundoora (AU); Steven R. Webb, Westfield, IN (US); Manju Gupta, Carmel, IN (US); W. Mike Ainley, Carmel, IN (US); Matthew J. Henry, Indianapolis, IN (US); John Mason, Preston (AU); Sandeep Kumar, Carmel, IN (US); Stephen Novak, Westfield, IN (US)

(73) Assignee: Dow AgroSciences LLC, Indianapolis, IN (US)

( * ) Notice: Subject to any disclaimer, the term of this patent is extended or adjusted under 35 U.S.C. 154(b) by 871 days.

(21) Appl. No.: 14/020,575

(22) Filed: Sep. 6, 2013

(65) Prior Publication Data

US 2014/0090113 A1 Mar. 27, 2014

Related U.S. Application Data

(60) Provisional application No. 61/697,882, filed on Sep. 7, 2012.

(51) Int. Cl.
*C12N 15/82* (2006.01)

(52) U.S. Cl.
CPC ............................... *C12N 15/8213* (2013.01)

(58) Field of Classification Search
None
See application file for complete search history.

(56) References Cited

U.S. PATENT DOCUMENTS

| | | | |
|---|---|---|---|
| 2003/0232410 A1 | 12/2003 | Liljedahl et al. | |
| 2005/0026157 A1 | 2/2005 | Baltimore et al. | |
| 2005/0064474 A1 | 3/2005 | Urnov et al. | |
| 2005/0172365 A1 | 8/2005 | Puchta | |
| 2005/0208489 A1 | 9/2005 | Carroll et al. | |
| 2006/0130179 A1 | 6/2006 | Suttie | |
| 2006/0188987 A1 | 8/2006 | Guschin et al. | |
| 2008/0182332 A1* | 7/2008 | Cai | C07K 14/4702 435/468 |
| 2009/0205083 A1 | 8/2009 | Gupta et al. | |
| 2010/0162436 A1 | 6/2010 | Falco et al. | |
| 2010/0257638 A1 | 10/2010 | Cai et al. | |
| 2011/0189775 A1 | 8/2011 | Ainley et al. | |
| 2011/0191877 A1 | 8/2011 | Russell et al. | |
| 2011/0191899 A1 | 8/2011 | Ainley et al. | |

FOREIGN PATENT DOCUMENTS

| | | | |
|---|---|---|---|
| CN | 209006297 | 1/2009 | |
| CN | 2009006297 A2 | 1/2009 | |
| WO | 2003004659 | 1/2003 | |
| WO | WO 2003/004659 A2 | 1/2003 | |
| WO | 2007014275 A2 | 2/2007 | |
| WO | WO-2007014275 A2 * | 2/2007 | ............. C12N 15/09 |
| WO | WO2009006297 | 6/2007 | |
| WO | 2009006297 | 1/2009 | |
| WO | WO2011/091317 | 1/2010 | |
| WO | 2010143917 | 12/2010 | |
| WO | WO-2010143917 A2 * | 12/2010 | ............... C12N 9/10 |
| WO | 2014039684 | 3/2014 | |
| WO | 2014039692 | 3/2014 | |
| WO | 2014039702 | 3/2014 | |
| WO | 2014039970 | 3/2014 | |

OTHER PUBLICATIONS

D'Halluin, K., et al., "Homologous recombination: a basis for targeted genome optimization in crop species such as maize," Plant Biotechnology Journal, vol. 6, Issue 1, pp. 93-102 (2008).
Terada, R., et al., "Efficient gene targeting by homologous recombination in rice," Nature Biotechnology 20, pp. 1030-1034 (2002).
Terada, R., et al., "Gene Targeting by Homologous Recombination as a Biotechnological Tool for Rice Functional Genomics" Plant Physiology, Jun. 2007, vol. 144, pp. 846-856.
NCBI, GenBank accession No. AC189411.2,Sep. 11, 2008.
Puchta, Holger, "Marker-free transgenic plants" Plan Cell, Tissue and Organ Culture, Aug. 2003, pp. 123-134, vol. 74, No. 2.
International Search Report and Written Opinion from International Application No. PCT/US2013/058584, dated Dec. 23, 2013, 12 pages.
Database EMBL, Mar. 12, 2009, genomic survey sequence, BOTO1-50C24TF BOTO1 Brassica oleracea genomic clone.
Gupta, Manju et al., "Transcirtional activation of *Brassica napus* ss-ketoacyl-ACP synthase II with an enginerred zinc finger protein transcription factor," Plant Biotechnoloyg Jurnal, Sep. 1, 2012, pp. 783-791, vol. 10, No. 7.
Townsend, Jeffry A., et al., "High-frequencey modification of plant genes using engineered zinc-finger nucleases," Nature, May 21, 2009, pp. 442-445, vol. 459, No. 7245.

(Continued)

*Primary Examiner* — Matthew R Keogh

(57) ABSTRACT

An Engineered Transgene Integration Platform (ETIP) is described that can be inserted randomly or at targeted locations in plant genomes to facilitate rapid selection and detection of a GOI that is perfectly targeted (both the 5' and 3' ends) at the ETIP genomic location. One element in the subject disclosure is the introduction of specific double stranded breaks within the ETIP. In some embodiments, an ETIP is described using zinc finger nuclease binding sites, but may utilize other targeting technologies such as meganucleases, CRISPRs, TALs, or leucine zippers. Also described are compositions of, and methods for producing, transgenic plants wherein the donor or payload DNA expresses one or more products of an exogenous nucleic acid sequence (e.g. protein or RNA) that has been stably-integrated into an ETIP in a plant cell. In embodiments, the ETIP facilitates testing of gene candidates and plant expression vectors from ideation through Development phases.

27 Claims, 83 Drawing Sheets

Specification includes a Sequence Listing.

(56) References Cited

OTHER PUBLICATIONS

Zeevi et al.: "Zinc Finger Nuclease and Horning Endonuclease-Mediated Assembly of Muitigene Plant Transformation Vectors", Plant Physiology, 2012, vol. 158: 132-144.

Yang, Q. et al. "Identification of FAD2 and FAD3 genes in *Brassica napus* genome and development of allele-specific markers for high oleic and low linolenic acid contents." Theoretical and applied genetics 125.4 (2012): 715-729.

Cai et al., "Targeted transgene integration in plant Apr. 2009 cells using designed zinc finger nucleases," Plant Molecular Biology, vol. 69 No. 6, pp. 699-709.

Genbank AC189411.2 available at https://www.ncbi.nlm.nih.gov/nuccore/AC189411.2.

\* cited by examiner

```
                                  1                                      40
FAD2-3 (SEQ ID NO:8)      (1)  ATGGCGCCAGGTGCAAGAATGCAAGTNCTCCTCCCTCCA
 FAD2A (SEQ ID NO:5)      (1)  ATGGCGCCAGGTGGAAGAATGCAAGTNCTCCTCCCTCCA
FAD2-2 (SEQ ID NO:7)      (1)  ATGGGCGCAGGTGGAAGAATGCAAGTCTCTCCTCCCTCCA
FAD2-1 (SEQ ID NO:6)      (1)  ATGGGCGCAGGTGGAAGAATGCAAGTCTCTCCTCCCTCCA 41                                     80
FAD2-3 (SEQ ID NO:8)     (41)  AGAANCNGNAACCNANANCATCAANCGCGTACCCTGCGA
 FAD2A (SEQ ID NO:5)     (41)  AAAANCNGNAACCNANACATCAANCGCGTACCCTGCGA
FAD2-2 (SEQ ID NO:7)     (41)  NNCCCGAAACCAAANCNTCAAACGCGTNCCCTGCGA
FAD2-1 (SEQ ID NO:6)     (41)  NNCCCGGAACCAACANCNTCAAACGCGTNCCCTGCGA 81                                    120
FAD2-3 (SEQ ID NO:8)     (81)  GACACCNCCNTTCACTNTCGGAGAACTCAAGAAAGCAATC
 FAD2A (SEQ ID NO:5)     (81)  GACACCNCCNTTCACTNTCGGAGAACTCAAGAAAGCAATC
FAD2-2 (SEQ ID NO:7)     (81)  GACACCACCNTTCACTCTCGGAGANCTCAAGAAAGCAATC
FAD2-1 (SEQ ID NO:6)     (81)  GACACCACCATTCACTCTCGGAGANCTCAAGAAAGCAATC 121                                   160
FAD2-3 (SEQ ID NO:8)    (121)  CCACCGCACTGNTTCAAACGCTCNATCCCNCGCTCNTTCT
 FAD2A (SEQ ID NO:5)    (121)  CCACCGCACTGNTTCAAACGCTCNATCCCNCGCTCNTTCT
FAD2-2 (SEQ ID NO:7)    (121)  CCACCNCACTGCTTCAAACGCTCCATCCCNCGCTCCTTCT
FAD2-1 (SEQ ID NO:6)    (121)  CCACCNCACTGCTTCAAACGCTCCATCCCACGCTCCTTCT 161                                   200
FAD2-3 (SEQ ID NO:8)    (161)  CCTNCNTCNNCNGNNACAT--CATCNTANCTCCTNCNTC
 FAD2A (SEQ ID NO:5)    (161)  CCTNCNTCNNCNGNNACAT---CATCNTANCTCCTNCNTC
FAD2-2 (SEQ ID NO:7)    (161)  CCTNCNTCCNCTNCNACAT---CNTCGTNTNCTCCTCCCTC
FAD2-1 (SEQ ID NO:6)    (161)  CCT-CTTCGACANCATCATCTNCTNCTNGCTCCTCCCTC 201                                   240
FAD2-3 (SEQ ID NO:8)    (199)  TACNACNTCGCCACNACNTACTTCCCTCTCCNNNNN
 FAD2A (SEQ ID NO:5)    (199)  TACNACNTCGCCACNACNTACTTCCCTCTCCNNNNN
FAD2-2 (SEQ ID NO:7)    (199)  TACCACCTCNCCACANCCTACTTCCCTCTCCNNNCN
FAD2-1 (SEQ ID NO:6)    (200)  TACCACCTCNCCACANCCTACTTCCCTCTCC--------
```

FIG. 1A

```
                                      241                                         280
FAD2-3 (SEQ ID NO:8)    (239)  ░░░░CCTAC░TCGCCTG░CC░CTCTACTGGGCCTGCCA
 FAD2A (SEQ ID NO:5)    (239)  ░░░░CCTAC░TCGCCTG░CC░CTCTACTGGGCCTGCCA
FAD2-2 (SEQ ID NO:7)    (239)  ░░░░CC░TACCTCGCCTG░CCCCTCTACTGGGCCTGCCA
FAD2-1 (SEQ ID NO:6)    (231)  ------C░TACCTCGCCTGACCCCTCTACTGGGCCTGCCA 281                                         320
FAD2-3 (SEQ ID NO:8)    (279)  ░GGGTGCGTCCTAACCGGC░TCTGGGTCAT░GCCCACGA░
 FAD2A (SEQ ID NO:5)    (279)  GGG░TGCGTCCTAACCGGC░TCTGGGTCAT░GCCCACGA░
FAD2-2 (SEQ ID NO:7)    (279)  ░GG░TGCGTCCTAAC░GGCCTCTGGGTCATCGCCCACGAA
FAD2-1 (SEQ ID NO:6)    (265)  ░GG░TGCGTCCTAAC░GGCCTCTGGGTCAT░GCCCACGA░

321                                         360
FAD2-3 (SEQ ID NO:8)    (319)  TGCGGCCACCACGCCTTCAGCGAC░ACCAGTGGCTTGACG
 FAD2A (SEQ ID NO:5)    (319)  TGCGGCCACCACGCCTTCAGCGAC░ACCAGTGGCT░GACG
FAD2-2 (SEQ ID NO:7)    (319)  TGCGGCCACCACGCCTTCAGCGACCACCAGTGGCT░GACG
FAD2-1 (SEQ ID NO:6)    (305)  TGCGGCCACCACGCCTTCAGCGACCACCAGTGGCT░GACG 361                                         400
FAD2-3 (SEQ ID NO:8)    (359)  ACACCG░GGTCTCATCTTCCACTCCTTCCTCCTCGTCCC
 FAD2A (SEQ ID NO:5)    (359)  ACACCG░GG░CTCATCTTCCACTCCTTCCTCCTCGTCCC
FAD2-2 (SEQ ID NO:7)    (359)  AC░CCG░GG░CTC░TCTTCCACTCCTTCCTCCTCGTCCC
FAD2-1 (SEQ ID NO:6)    (345)  AC░CCGC░GG░CTC░TCTTCCACTCCTTCCTCCTCGTCCC 401                                         440
FAD2-3 (SEQ ID NO:8)    (399)  ░TACTTCTCCTGGAAGTACA░CAT░GACGCCACCATTCC
 FAD2A (SEQ ID NO:5)    (399)  ░TACTTCTCCTGGAAGTACA░CAT░GACGCCACCATTCC
FAD2-2 (SEQ ID NO:7)    (399)  ░TACTTCTCCTGGAAGTACA░CCAT░GACGCCACCATTCC
FAD2-1 (SEQ ID NO:6)    (385)  GTACTTCTCCTGGAAGTACATCCAT-GACGCCACCATTCC 441                                         480
FAD2-3 (SEQ ID NO:8)    (439)  AACAC░GG░TCCCTCGA░AGAGA░GAAGTGTT░GTCCCCA
 FAD2A (SEQ ID NO:5)    (439)  AACAC░GG░TCCCTCGA░AGAGA░GAAGTGTT░GTCCCCA
FAD2-2 (SEQ ID NO:7)    (439)  AACACCGGATCCCTCGA░AG░GATGAAGTGTTCGTCCCCA
FAD2-1 (SEQ ID NO:6)    (424)  AACACCGGATCCCTCGATAC░GA░GAAGTGTTCGTCCCCA
```

FIG. 1B

```
                                    481                                    520
FAD2-3  (SEQ ID NO:8)    (479)  AGAAGAAATCAGACATCAAGTGGTACGGAAAGTACCTCAA
 FAD2A  (SEQ ID NO:5)    (479)  AGAAGAAATCAGACATCAAGTGGTACGGAAAGTACCTCAA
FAD2-2  (SEQ ID NO:7)    (479)  AGAAGAAATCGACATCAAGTGGTACGGAAAGTACCTCAA
FAD2-1  (SEQ ID NO:6)    (464)  AGAAGAAATCGACATCAAGTGGTACGGAAAGTACCTCAA 521                                    560
FAD2-3  (SEQ ID NO:8)    (519)  CAACCCGTGGACGCACCGTGATGCTAACGGTCCAGTTC
 FAD2A  (SEQ ID NO:5)    (519)  CAACCCGTGGACGCACCGTGATGCTAACGGTCCAGTTC
FAD2-2  (SEQ ID NO:7)    (519)  CAACCCGCTAGGACGCACGTGATGCTAACCGTCCAGTTC
FAD2-1  (SEQ ID NO:6)    (504)  CAACCCGCTAGGACGCACGTGATGCTAACCGTCCAGTTC 561                                    600
FAD2-3  (SEQ ID NO:8)    (559)  AGCTCGGCTGGCCTTGTACTTAGCCTTCAACGTCTCGG
 FAD2A  (SEQ ID NO:5)    (559)  AGCTCGGCTGGCCTTTGTACTTAGCCTTCAACGTCTCGG
FAD2-2  (SEQ ID NO:7)    (559)  AGCTCGGCTGGCCTTGTACTTAGCCTTCAACGTCTCTG
FAD2-1  (SEQ ID NO:6)    (544)  AAGCTCGGCTGGCCTTGTACTTAGCCTTCAACGTCTCGG 601                                    640
FAD2-3  (SEQ ID NO:8)    (599)  GAGACCTTACAACGAGGCTTCGCTTGCCATTTCCACCC
 FAD2A  (SEQ ID NO:5)    (599)  GGAGACCTTACAACGAGGCTTCGCTTGCCATTTCCACCC
FAD2-2  (SEQ ID NO:7)    (599)  GAGACCTTACAACGACGGTTCGCTTGCCATTTCCACCC
FAD2-1  (SEQ ID NO:6)    (584)  GAGACCTTACAACGACGGTTCGCTTGCCATTTCCACCC 641                                    680
FAD2-3  (SEQ ID NO:8)    (639)  CAACGCTCCCATCTACAACGACCGGAGCGTCTCCAGATA
 FAD2A  (SEQ ID NO:5)    (639)  CAACGCTCCCATCTACAACGACCGTGAGCGTCTCCAGATA
FAD2-2  (SEQ ID NO:7)    (639)  AACGCTCCCATCTACAACGACCGGAGCGTCTCCAGATA
FAD2-1  (SEQ ID NO:6)    (624)  AACGCTCCCATCTACAACGACCGGAGCGTCTCCAGATA 681                                    720
FAD2-3  (SEQ ID NO:8)    (679)  TACATCTCCGACGCTGGCATCCTCGCCGTGTGCTACGGTC
 FAD2A  (SEQ ID NO:5)    (679)  TACATCTCCGACGCTGGCATCCTCGCCGTGTGCTACGGTC
FAD2-2  (SEQ ID NO:7)    (679)  TACATCTCGACGCTGGCGTCCTCGCCGTATGGTACGGTC
FAD2-1  (SEQ ID NO:6)    (664)  TACATCTCGACGCTGGCGTCCTCGCCGTATGGTACGGTC
```

FIG. 1C

```
                              721                                      760
FAD2-3 (SEQ ID NO:8)   (719)  TCTTCCGCTACGCCGCCGCCCAGGGAGTTGCCTCTATGGT
 FAD2A (SEQ ID NO:5)   (719)  TCTCCCGCTACGCCGCCGTCCAGGGAGTTGCCTCTATGGT
FAD2-2 (SEQ ID NO:7)   (719)  TCTCCCGCTACGCCGGCGCCCAGGAGTTGCCTCTCTGGT
FAD2-1 (SEQ ID NO:6)   (704)  TCTCCCGTACGCCGCCGCCGGAGTAGCCTCTGTGGT 761                                      800
FAD2-3 (SEQ ID NO:8)   (759)  CTGCGTCTACGGAGTCCCGCTTCTGATTGTCAATGGGTTC
 FAD2A (SEQ ID NO:5)   (759)  CTGCGTCTACGGAGTTCCTCTTCTGATTGTCAAGGGTTC
FAD2-2 (SEQ ID NO:7)   (759)  CTGCGTCTACGGAGTTCCGCTTATGATTGTCAAGGGTTC
FAD2-1 (SEQ ID NO:6)   (744)  CTGCGTCTACGGAGTTCCGCTTTAATTGTCAAGGGTTC 801                                      840
FAD2-3 (SEQ ID NO:8)   (799)  TTGTGTTGATCACTTACTTGCAGCACACGCACCCTTCCC
 FAD2A (SEQ ID NO:5)   (799)  TTAGTTTGATCACTTACTTGCAGCACACGCACCCTTCCC
FAD2-2 (SEQ ID NO:7)   (799)  TTGTGTTGATCACTTACTTGCAGCACACGCACCCTTCGC
FAD2-1 (SEQ ID NO:6)   (784)  TTGTGTTGATCACTTACTTGCAGCACACGCACCCTTCGC 841                                      880
FAD2-3 (SEQ ID NO:8)   (839)  TGCCTCACTACGACTCGTCGGAGTGGGATTGGTTGACGGG
 FAD2A (SEQ ID NO:5)   (839)  TGCCTCACTACGACTCGTCTGAGTGGGATTGGTTGACGGG
FAD2-2 (SEQ ID NO:7)   (839)  TGCCTCACTACGACTCGTCGGAGTGGGATTGGTTGAGAGG
FAD2-1 (SEQ ID NO:6)   (824)  TGCCTCACTACGACTCGTCGGAGTGGGATTGGTTGAGAGG 881                                      920
FAD2-3 (SEQ ID NO:8)   (879)  AGCTTTGGCTACCGTCGACAGAGACTACGGAATCTTGAAC
 FAD2A (SEQ ID NO:5)   (879)  AGCTTTGGCCACCGTCGACAGAGACTACGGAATCTTGAAC
FAD2-2 (SEQ ID NO:7)   (879)  AGCTTTGGCTACCGTGGAAAGAGACTACGGAATCTTGAAC
FAD2-1 (SEQ ID NO:6)   (864)  AGCTTTGGCTACCGTGGAAAGAGACTACGGAATCTTGAAC 921                                      960
FAD2-3 (SEQ ID NO:8)   (919)  AAGGTCTTCCACAACATTACCGACACGCACGTGGCGCATC
 FAD2A (SEQ ID NO:5)   (919)  AAGGTCTTCCACAACATAACGGACACGCACGTGGCGCATC
FAD2-2 (SEQ ID NO:7)   (919)  AAGGTCTTTCAAAACATCACGGACACGCACGTGGCGCATC
FAD2-1 (SEQ ID NO:6)   (904)  AAGGTCTTTCAAAACATCACGGACACGCACGTGGCGCATC
```

FIG. 1D

```
                              961                                      1000
FAD2-3 (SEQ ID NO:8)   (959)  ACTGTTCTCCACCATGCCGCATTATAACGCGATGGAAGC
 FAD2A (SEQ ID NO:5)   (959)  ACCTGTTCTCCACCATGCCGCATTATAACGCGATGGAAGC
FAD2-2 (SEQ ID NO:7)   (959)  ACTGTTCTCCACCATGCCGCATTATAACGCGATGGAAGC
FAD2-1 (SEQ ID NO:6)   (944)  ACTGTTCTCCACCATGCCGCATTATAACGCGATGGAAGC 1001                                     1040
FAD2-3 (SEQ ID NO:8)   (999)  ACGAAGGCGATAAAGCCGATACTG-GGAGAGTATTACCA
 FAD2A (SEQ ID NO:5)   (999)  ACGAAGGCGATAAAGCCGATACTG-GGAGAGTATTACCA
FAD2-2 (SEQ ID NO:7)   (999)  GACGAAGGCGATAAAGCCGATACTG-GGAGAGTATTACCA
FAD2-1 (SEQ ID NO:6)   (984)  GACGAAGGCGATAAAGCCGATACTTGGAGAGTATTACCA 1041                                     1080
FAD2-3 (SEQ ID NO:8)  (1038)  GTTCGATGGAACGCCGGAGGTTAAGGCGATGTGGAGGGAG
 FAD2A (SEQ ID NO:5)  (1038)  GTTCGATGGAACGCCGGAGGTTAAGGCGATGTGGAGGGAG
FAD2-2 (SEQ ID NO:7)  (1038)  GTTCGATGGAACGCCGGAGGTTAAGGCGATGTGGAGGGAG
FAD2-1 (SEQ ID NO:6)  (1024)  GTTCGATGGAACGCCGGCGGTTAAGGCGATGTGGAGGGAG 1081                                     1120
FAD2-3 (SEQ ID NO:8)  (1078)  GCGAAGGAGTGTATCTATGTGGAACCGGACAGGCAAGGTG
 FAD2A (SEQ ID NO:5)  (1078)  GCGAAGGAGTGTATCTATGTGGAACCGGACAGGCAAGGTG
FAD2-2 (SEQ ID NO:7)  (1078)  GCGAAGGAGTGTATCTATGTGGAACCGGAAAGGCAAGGTG
FAD2-1 (SEQ ID NO:6)  (1064)  GCGAAGGAGTGTATCTATGTGGAACCGGAAAGGCAAGGTG 1121                                     1160
FAD2-3 (SEQ ID NO:8)  (1118)  AGAAGAAAGGTGTGTTCTGG--------------------
 FAD2A (SEQ ID NO:5)  (1118)  AGAAGAAAGGTGTGTTCTGGACAACAACTACTACTCTT
FAD2-2 (SEQ ID NO:7)  (1118)  AGAAGAAAGGTGTGTTCTGGACAACAACTACTACGAG
FAD2-1 (SEQ ID NO:6)  (1104)  AGAAGAAAGGTGTGTTCTGGACAACAA-----------

1161
FAD2-3 (SEQ ID NO:8)  (1138)  ----
 FAD2A (SEQ ID NO:5)  (1158)  CAA
FAD2-2 (SEQ ID NO:7)  (1158)  AGG
FAD2-1 (SEQ ID NO:6)  (1135)  ----
```

FIG. 1E

```
                                         1                                      40
FAD3A   (SEQ ID NO:15)   (1)   CATCGAGGCTTCTTCACCACATTCACTCAGGCGCG
FAD3A'  (SEQ ID NO:16)   (1)   CATCGAAGCTTCTTCACCACATTCCAGTCCCAAACTT
FAD3C'  (SEQ ID NO:20)   (1)   CATCGAAGCTTCTTCACCACATTCCAGTTCCCAACTT
FAD3A'' (SEQ ID NO:17)   (1)   CATCAAG-CTTCTTCACCACATTCAGTGAAGGCG
FAD3C'' (SEQ ID NO:19)   (1)   CATCAAG-CTTTATCACCACATTCAGTGAAGGCG
FAD3C   (SEQ ID NO:18)   (1)   CATCAAA--CTCTTCCACCACATTCAGTCGGCGCG 41                                     80
FAD3A   (SEQ ID NO:15)   (41)  ACAGCTTCAG------AGAGAGAGAACATCCCTCAAA
FAD3A'  (SEQ ID NO:16)   (41)  TCTCTTCTTTTGAATTATAGAGAGAGAATCCTCCCAAA
FAD3C'  (SEQ ID NO:20)   (41)  TCTCTTCTTTT-GAATTATAGAGAGAATCCTCCCAAA
FAD3A'' (SEQ ID NO:17)   (40)  ACACCT----------AGAGAGAGA--AACTCGCCAAA
FAD3C'' (SEQ ID NO:19)   (40)  ACACCT----------AGAGAGAGA--AACTCGCCAAA
FAD3C   (SEQ ID NO:18)   (39)  ACAGCTTCAG------AGAGAGAGA--AACATCCTCAAA 81                                    120
FAD3A   (SEQ ID NO:15)   (75)  GCTCTCTCCCTCCCGCCATGGTTGTCGCTATGGACC
FAD3A'  (SEQ ID NO:16)   (81)  CCTCTCTCCCC-----CCAGGATGGTTGTCGCTATGGACC
FAD3C'  (SEQ ID NO:20)   (80)  CCTCTCTCCCCCCCCAGGATGGTTGTCGCTATGGACC
FAD3A'' (SEQ ID NO:17)   (68)  CCTCTCTC------CCCACAAATGGTTGTCGCTATGGACC
FAD3C'' (SEQ ID NO:19)   (68)  CCTCTCTC------CCACCAATGGTTGTCGCTATGGACC
FAD3C   (SEQ ID NO:18)   (71)  GCTCTCTC--CTCCCGCCATGGTTGTCGCTATGGACC 121                                   160
FAD3A   (SEQ ID NO:15)   (115) AACGTACCAATGCAACGCAGA-----------------
FAD3A'  (SEQ ID NO:16)   (117) AACGCACCAATGTCAACGCAGACGCCCCCCCCAACCC
FAD3C'  (SEQ ID NO:20)   (120) AACGCACCAATGTCAACGAAGACGCCCCCCCCAACCC
FAD3A'' (SEQ ID NO:17)   (102) ACCGCAGCAATGTTAACGCAGACCCCCCCCCCAACC
FAD3C'' (SEQ ID NO:19)   (102) ACCGCAGCAATGTTAACGCAGACCCCCCCCCCAACC
FAD3C   (SEQ ID NO:18)   (109) AACGTACCAATGTCAACGCAGATCC---------AACG
```

FIG. 3A

```
                                         161                                    200
FAD3A   (SEQ ID NO:15)  (137)  CGAAAGGTTTGATCCNAGCGNACAACCNCCGTTCAAGATC
FAD3A'  (SEQ ID NO:16)  (157)  NGAANGGTTTGATCCNAGCGNACAACCGCCGTTNAAGATC
FAD3C'  (SEQ ID NO:20)  (160)  NGAANGGTTTGATCCNAGCGNACAACCGCCGTTNAAGATC
FAD3A'' (SEQ ID NO:17)  (142)  NGAANGGTTTGATCCAAGCGAACAACCNCCGTTNAAGATC
FAD3C'' (SEQ ID NO:19)  (142)  NGAANGGTTTGATCCAAGCGNACAACCNCCGTTNAAGATC
FAD3C   (SEQ ID NO:18)  (140)  CGAAAGGTTTGATCCNAGCGNACAACCNCCGTTNAAGATC 201                                    240
FAD3A   (SEQ ID NO:15)  (177)  GGNGANATNAGGGCGGCCATTCCTAAGCATTGNTGGGTAN
FAD3A'  (SEQ ID NO:16)  (197)  GGGGACATNAGGGCNGCNATTCCTAAGCATTGNTGGGTNA
FAD3C'  (SEQ ID NO:20)  (200)  GGGGACATNAGGGCNGCNATTCCTAAGCATTGNTGGGTNA
FAD3A'' (SEQ ID NO:17)  (182)  GGNGANATCAGGGCGGCNATTCCTAAGCATTGNTGGGTNA
FAD3C'' (SEQ ID NO:19)  (182)  GGNGANATNAGGGCGGCNATTCCTAAGCATTGCTGGGTNA
FAD3C   (SEQ ID NO:18)  (180)  GGNGANATNAGGGCNGCNATTCCTAAGCATTGNTGGGTCA 241                                    280
FAD3A   (SEQ ID NO:15)  (217)  ANAGTCCTTTGAGATCCATGAGCTATGTNGCNAGAGACAT
FAD3A'  (SEQ ID NO:16)  (237)  AAAGTCCTTTGAGATCNATGAGCTANGTAGCNAGAGACAT
FAD3C'  (SEQ ID NO:20)  (240)  AAAGTCCTTTGAGATCNATGAGCTANGTAGCNAGAGACAT
FAD3A'' (SEQ ID NO:17)  (222)  ANAGTCCTTTGAGATCNATGAGCTANGTNGCNAGAGACAT
FAD3C'' (SEQ ID NO:19)  (222)  ANAGTCCTTTGAGATCNATGAGCTANGTNGCNAGAGACAT
FAD3C   (SEQ ID NO:18)  (220)  ANAGTCCTTTGAGATCCATGAGCTANGTNGCGAGAGACAT 281                                    320
FAD3A   (SEQ ID NO:15)  (257)  TTNNCCGTCGTNGCTNTTGCCGTCGCCGCCGTGTATTTT
FAD3A'  (SEQ ID NO:16)  (277)  TTGTNCCGTCGNNGCTTTNGCCNTTGCCGCCGTGTATTTT
FAD3C'  (SEQ ID NO:20)  (280)  TTGTNCCGTCGNTGCTTTNGCCNTTGCCGCCGTGTATTTT
FAD3A'' (SEQ ID NO:17)  (262)  TTNNCCGTCGNNGCTNTNGCCNTGGCCGCCGTGTATTTT
FAD3C'' (SEQ ID NO:19)  (262)  TTNNCCGTCGNNGCTNTNGCCNTGGCCGCCGTGTATTTT
FAD3C   (SEQ ID NO:18)  (260)  TTNNTCCGTCGTNGCTNTNGCCGTCNCCGCCGTGTATTTT
```

FIG. 3B

```
                                          321                                    360
FAD3A   (SEQ ID NO:15)  (297) GATAGCTGGTTCTTTTGCCTCTTTATGGGCGCCCAAG
FAD3A'  (SEQ ID NO:16)  (317) GATAGCTGGTTCTTTGTCCTCTTTATGGGCGCCCAAG
FAD3C'  (SEQ ID NO:20)  (320) GATAGCTGGTTCTTTGCCTCTTTATGGGCGCCCAAG
FAD3A'' (SEQ ID NO:17)  (302) GATAGCTGGTTCTTTGCCACTTTACTGGGTGCCCAAG
FAD3C'' (SEQ ID NO:19)  (302) GATAGCTGGTTCTTTGCCACTTTACTGGGTGCCCAAG
FAD3C   (SEQ ID NO:18)  (300) GATAGCTGGTTCTTTGCCTCTTTATGGGCGCCCAAG 361                                    400
FAD3A   (SEQ ID NO:15)  (337) GAACCCTGTTCTGGGCTATCTTCGTACTGGCCACGACTG
FAD3A'  (SEQ ID NO:16)  (357) GAACCCTTTTCTGGGCTATCTTCGTCCTGGCCACGACTG
FAD3C'  (SEQ ID NO:20)  (360) GAACCCTTTTCTGGGCTATCTTCGTCCTGGCCACGACTG
FAD3A'' (SEQ ID NO:17)  (342) GAACCCTTTTCTGGGCTATCTTCGTTCTTGGCCACGACTG
FAD3C'' (SEQ ID NO:19)  (342) GAACCCTTTTCTGGGCTATCTTCGTTCTTGGCCACGACTG
FAD3C   (SEQ ID NO:18)  (340) GAACCCTTTTCTGGGCTATCTTCGTACTGGCCACGACTG 401                                    440
FAD3A   (SEQ ID NO:15)  (377) GTAATAATTTT----------TCTTTCAACTTCTTA
FAD3A'  (SEQ ID NO:16)  (397) GTAA----AGTTT-----------------------
FAD3C'  (SEQ ID NO:20)  (400) GTAA----AGTTT-----------------------
FAD3A'' (SEQ ID NO:17)  (382) GTAAATAAATTT----------------------CTG
FAD3C'' (SEQ ID NO:19)  (382) GTAAATAAATTT----------------------CG
FAD3C   (SEQ ID NO:18)  (380) GTAATAATTTTCAATTTATTTTTCTTCAACTTCTTA 441                                    480
FAD3A   (SEQ ID NO:15)  (406) TTGATATGTTTAAGTTTGTTTCA
FAD3A'  (SEQ ID NO:16)  (406) CTTCCAT-------------------TTCAC
FAD3C'  (SEQ ID NO:20)  (409) CTTCCAT-------------------TTCAC
FAD3A'' (SEQ ID NO:17)  (399) TTAAT-------ATGAC-TTGTTCAAT
FAD3C'' (SEQ ID NO:19)  (399) TTAAT-------ATGC-TTGTTCAAT
FAD3C   (SEQ ID NO:18)  (420) TTGATATGTTTAAGTTT-GTTTCAC
```

FIG. 3C

```
                                              481                              520
FAD3A   (SEQ ID NO:15)   (446) CTTTGATTTTTTGACCGTACGTTCGAAATGAGATTTT--
FAD3A'  (SEQ ID NO:16)   (423) ATCG-ATTTATTGAAGGACGTTCTACCACG-ATTGTTTG
FAD3C'  (SEQ ID NO:20)   (426) ATCG-ATTTATTGAAGGACGTTCTACCACG-ATTGT----
FAD3A'' (SEQ ID NO:17)   (431) ATTA-ATTTGTTGAAGGACGTTCGACACG-ATCGTGT
FAD3C'' (SEQ ID NO:19)   (431) ATTA-ATTTGTTGAAGGACGTTCGACACG-ATCGT--
FAD3C   (SEQ ID NO:18)   (459) CTTTGATTTGTTGAACGACGTTCGAATGAGATTTT--
                                              521                              560
FAD3A   (SEQ ID NO:15)   (484) ---ATGACTTGAGATTGATTCTCTTCAGGTTTACTTTT
FAD3A'  (SEQ ID NO:16)   (461) TGAGTTACTTGGTAAAATGATTCTTTTATGTTCATTTTT
FAD3C'  (SEQ ID NO:20)   (461) -GAGT-ACTTTGTGAAGGATTCTTTTATGTTCATTTTT
FAD3A'' (SEQ ID NO:17)   (469) -CATGACTTGAGATTAATTCTTTTGAGGTT-ACTTT
FAD3C'' (SEQ ID NO:19)   (467) --ATGACTTGAGATTAATTCTTTGAGGTT-ACTTT
FAD3C   (SEQ ID NO:18)   (497) ---ATGACTTGAGATTGATTCTCTTCAGGTTTACTTT
                                              561                              600
FAD3A   (SEQ ID NO:15)   (522) TTAATTTAATTATTGTTCATCCGATTTGGCCTGCT
FAD3A'  (SEQ ID NO:16)   (501) TGAAGTTCGAAG-ATTT-------------------TT
FAD3C'  (SEQ ID NO:20)   (499) TGAAGTTCGAAG-ATTT-------------------TT
FAD3A'' (SEQ ID NO:17)   (507) T-ATGTTCAATATTG---------GG---------GAAT
FAD3C'' (SEQ ID NO:19)   (504) T-ATGTTGAATATTG---------GG---------GAAT
FAD3C   (SEQ ID NO:18)   (535) AAAAAAAAAAAGTATTGTGTTCACCCGAATTGGCCTGCT
                                              601                              640
FAD3A   (SEQ ID NO:15)   (562) GCAAGCAAAGGGGATGTGAGATTTTGAATTGTTTGTT
FAD3A'  (SEQ ID NO:16)   (520) G----------------TTT-AGATTTCT-TTTAAGCG
FAD3C'  (SEQ ID NO:20)   (518) G---------------TTTAGATTTCT-TTTAAGCG
FAD3A'' (SEQ ID NO:17)   (529) AGGTAAGTTAGGTGTAGATTT--TTGTTGTT
FAD3C'' (SEQ ID NO:19)   (526) AGGGAAGTTAGGTGTAGATTT--TTGTGTT
FAD3C   (SEQ ID NO:18)   (575) GCAAGCAAAGGGGATGTGAGATTTTAATTGTTTCTT
```

FIG. 3D

```
                                    641                               680
FAD3A   (SEQ ID NO:15)  (602)  ...TT.TTG.T--------------TC.T..T.ATC..-T
FAD3A'  (SEQ ID NO:16)  (543)  ......C.C.C.A------------C...T.ATCG.-T
FAD3C'  (SEQ ID NO:20)  (542)  ......C.C.C.-------------...T.ATCG.-T
FAD3A'' (SEQ ID NO:17)  (567)  --...A..G.------------.CA..ACT.ATC..-T
FAD3C'' (SEQ ID NO:19)  (564)  A...A..G.-------------.CG..ACT.ATC..-T
FAD3C   (SEQ ID NO:18)  (615)  ..TCAGTC.T.A.ACTGCTAACTT.TT.T..TGATC.AAT 681                               720
FAD3A   (SEQ ID NO:15)  (626)  CGTA.CACTC--------C.AA.T.AA.ATCTTT..TTTC
FAD3A'  (SEQ ID NO:16)  (569)  CGT.C.ACTC----..TACAA..CCA.ATCTT--.ATTT.
FAD3C'  (SEQ ID NO:20)  (565)  CGT.C.ACTC----..TACAAA.CCA.ATCTT--.ATTT.
FAD3A'' (SEQ ID NO:17)  (591)  CGT..A.ACTC-------G.AA.C.A.ATATCTT---.TTT.
FAD3C'' (SEQ ID NO:19)  (590)  CGTC.A.ACTC-------G.AA.C.A.ATATCTT----.TTT.
FAD3C   (SEQ ID NO:18)  (655)  CGT..CACTCATAA..CC.AA.T.AA.ATCTTT..TTTC 721                               760
FAD3A   (SEQ ID NO:15)  (659)  CTATAATTAT.G.T..TTCCGC.TTT.ATGGATCT.....
FAD3A'  (SEQ ID NO:16)  (603)  CTATAATTAC..CT.CTTCCGC.TTTT.ATGGATCTCTCAA
FAD3C'  (SEQ ID NO:20)  (599)  CTATAATTACG.CT.CTTCCGC.TTT.ATGGATCTCTCAA
FAD3A'' (SEQ ID NO:17)  (621)  CTATAATTAA..TA.TTCCGC.TTTA.ATGGATC.A.C..
FAD3C'' (SEQ ID NO:19)  (620)  CTATAATTAA..TA.TTCCGC.TTT.ATGGATC.A...T.
FAD3C   (SEQ ID NO:18)  (695)  CTATAATTAT.G.T.GTTCCGC.TTT.ATGGATCT.C...

761                               800
FAD3A   (SEQ ID NO:15)  (699)  .-.AA.TTTC.AA-----------------TAAA.----
FAD3A'  (SEQ ID NO:16)  (643)  C.TA..AT.AAG------------------TATA.TAT.
FAD3C'  (SEQ ID NO:20)  (639)  C.TA..AT.AAG------------------TATA.AAT.
FAD3A'' (SEQ ID NO:17)  (661)  ...A.G.TC..A.ATTTGTTTCTCTTTCTC.AGAT.CC.
FAD3C'' (SEQ ID NO:19)  (660)  ...A.G.TC..A.TTTTGTTTCTCTTTCTC.AGAT.CC.
FAD3C   (SEQ ID NO:18)  (735)  .-.AA.GT...CA.------------------TAAA.---
```

FIG. 3E

```
                                801                                840
FAD3A   (SEQ ID NO:15)  (717)  ---AAATTTATTGTT-TGT-GTA----ACAATT----
FAD3A'  (SEQ ID NO:16)  (665)  AAGAAAATCTATTATTTTGTAAACAAGA-AAGAT----
FAD3C'  (SEQ ID NO:20)  (661)  AAGAAAATCTATTGTTTTGTAAACAAGA-AAGAT----
FAD3A'' (SEQ ID NO:17)  (701)  GGAACTTTAATTATAATAAATATGTATAAAATCAAG
FAD3C'' (SEQ ID NO:19)  (700)  GGAACTTTAATTATAATAAATATGTATAAAATCAAG
FAD3C   (SEQ ID NO:18)  (753)  ---AAATTTATTGTT-TGAAGTA----ACAATT----

841                                880
FAD3A   (SEQ ID NO:15)  (744)  --AAT-AATGTTTATTGTTC----------------
FAD3A'  (SEQ ID NO:16)  (700)  --AAT--ATGTTTCTTGTTA----------------
FAD3C'  (SEQ ID NO:20)  (696)  --AAT--ATGTTTCTTGTTA----------------
FAD3A'' (SEQ ID NO:17)  (741)  AAAATAAATGTTTATTTTTTTGGCAACAAATATATTAC
FAD3C'' (SEQ ID NO:19)  (740)  AAAATAAATGTTTATTTTTT-GGCAACAAATATATT---
FAD3C   (SEQ ID NO:18)  (781)  --AAT-AATGTATTTGATTC----------------

881                                920
FAD3A   (SEQ ID NO:15)  (763)  ----TGG----------------G----------ATTA
FAD3A'  (SEQ ID NO:16)  (718)  -----------------------------------TTT
FAD3C'  (SEQ ID NO:20)  (714)  -----------------------------------TTT
FAD3A'' (SEQ ID NO:17)  (781)  TCTTGAGCTTTGACAAGAAAAAAATATATTGTTTTTTC
FAD3C'' (SEQ ID NO:19)  (777)  ----GAG--TTTGACAAGAAAAA--TATATTGTTTTTTC
FAD3C   (SEQ ID NO:18)  (800)  ----TGG----------------G----------ATTA 921                                960
FAD3A   (SEQ ID NO:15)  (772)  TGTGTGT-TGTTCCAATCTATTTTGAAATATAGTAAG
FAD3A'  (SEQ ID NO:16)  (721)  TGTGTAT---TTCCAATCTA-TTTCGAGATTAGAAAG
FAD3C'  (SEQ ID NO:20)  (717)  TGTGTAT---T-CCAATCTA-TTTCGAGATTAGAAAG
FAD3A'' (SEQ ID NO:17)  (821)  TCTTTTGGTTCCAATCTATTTTGAGATTAGAAAG
FAD3C'' (SEQ ID NO:19)  (810)  TCTTTTGGTTCCAATCTATTT-GTATTAGAAAG
FAD3C   (SEQ ID NO:18)  (809)  TGTGTGT-TGTTCCAATCTACTTTGAAATATAGTAAG
```

FIG. 3F

```
                                961                                      1000
FAD3A   (SEQ ID NO:15)  (811)   TGACACGTCATTTGTATTTTGGTACCTTGTTAAAGT
FAD3A'  (SEQ ID NO:16)  (757)   TGACACGTCAT-------------TACCTTGTTAATGT
FAD3C'  (SEQ ID NO:20)  (752)   TGTCACGTCAT-------------TACCTTGTTAAGTT
FAD3A'' (SEQ ID NO:17)  (861)   TGACACGTCATTACGGATTTGTACCTTGTTAAAAGT
FAD3C'' (SEQ ID NO:19)  (849)   TGACACGTCATTACGGATTTGTACCTTGTTAAAAGT
FAD3C   (SEQ ID NO:18)  (848)   TGACACGTCATTTGTATTTTGGTACCTTGTTGAAGT 1001                                     1040
FAD3A   (SEQ ID NO:15)  (851)   TTG----------AATGAGAAAGTTCAGTTAACATGT
FAD3A'  (SEQ ID NO:16)  (784)   TTA------AACAAACATGAAAAGTTAAATAA-ATAGT
FAD3C'  (SEQ ID NO:20)  (779)   TTA--------AACAAACATGAAAAGTTAAATAA-ATAGT
FAD3A'' (SEQ ID NO:17)  (901)   TTGGGTTAAACAAAGTGGAAAAGTTAAATAA-ATGT
FAD3C'' (SEQ ID NO:19)  (889)   TTGAGTTAAACAAAGTGGAAAAGTTAAATAA-ATGT
FAD3C   (SEQ ID NO:18)  (888)   TTG----------AATGGTAAAGTTAATTAACATGT 1041                                     1080
FAD3A   (SEQ ID NO:15)  (881)   GCATAAATGATAA-AGTTTT-----------ATGAT
FAD3A'  (SEQ ID NO:16)  (817)   GCATAAATGATATA-TTTTAT--TAG-TTAATGAT
FAD3C'  (SEQ ID NO:20)  (812)   GCATAAATGATATAC-TATTT--TCAG-TTAATGAT
FAD3A'' (SEQ ID NO:17)  (940)   GCATAAATGATAA-TCGTTTTTTGTAATCATGAT
FAD3C'' (SEQ ID NO:19)  (928)   GCACTAAATGATAA-TCGTTTTTGTTAAATATGAT
FAD3C   (SEQ ID NO:18)  (918)   GCATAAATGATAA-CTTTGT-----------ATGAT 1081                                     1120
FAD3A   (SEQ ID NO:15)  (908)   GTAAAATTTCATTTGAATAATA-CAGTGGACATGGAGCT
FAD3A'  (SEQ ID NO:16)  (854)   GTAAAA-TATAATTGAATAATGCAGTGGACATGGAGTT
FAD3C'  (SEQ ID NO:20)  (850)   GTAAAA-TATAATTGAATAATGCAGTGGACATGTGAGTT
FAD3A'' (SEQ ID NO:17)  (979)   GTAAAATAAATTGAATAATGCAGTGGACATGGAGTT
FAD3C'' (SEQ ID NO:19)  (967)   GTAAAATAAATTGAATAATGCAGTGGACATGGAGTT
FAD3C   (SEQ ID NO:18)  (945)   GTAAAATTCATTTGAATAATA-CAGTGGACATGGAGCT
```

FIG. 3G

```
                              1121                                    1160
FAD3A   (SEQ ID NO:15)  (947) TGTCAGACATTCCTCTTCTGAAAACGGCGGTTGGCCAAAT
FAD3A'  (SEQ ID NO:16)  (993) TGTCAGACATTCCTCTGCTGAAAAGGTGGTTGGCCAAAT
FAD3C'  (SEQ ID NO:20)  (889) TGTCAGACATTCCTCTGCTGAAAAGCGGTTGGCCAAAT
FAD3A'' (SEQ ID NO:17) (1019) TTTCAGACATTCCTCTGCTGAACAGGTGGTTGGCCACAT
FAD3C'' (SEQ ID NO:19) (1007) TGTCAGACATTCCTCTGCTGAACAGGTGGTTGGCCACAT
FAD3C   (SEQ ID NO:18)  (984) TGTCAGACATTCCTCTTCTGAAAACGGCGGTTGGCCAAAT
                              1161                                    1200
FAD3A   (SEQ ID NO:15)  (987) TCTTCATTCGTTCATTCTCGTTCCATACCATGGTTGGTAA
FAD3A'  (SEQ ID NO:16)  (933) TCTTCATTCGTTCATGCTCGTTCCGTACCATGGTTGGTAA
FAD3C'  (SEQ ID NO:20)  (929) TCTTCATTCGTTCATGCTCGTTCCGTACCATGGTTGGTAA
FAD3A'' (SEQ ID NO:17) (1059) TCTTCATTCATTCATGCTCGTTCCGTACCATGGTTGGTAA
FAD3C'' (SEQ ID NO:19) (1047) TCTTCATTCATTCATGCTCGTTCCGTACCATGGTTGGTAA
FAD3C   (SEQ ID NO:18) (1024) TCTTCATTCGTTCATTCTCGTTCCATACCATGGTTGGTAA
                              1201                                    1240
FAD3A   (SEQ ID NO:15) (1027) GTCAG-TTATTTAACTTGTTTTAAC-AA---TTT
FAD3A'  (SEQ ID NO:16)  (973) GTCAGCTTATC--AACC-GTTTT--ACTAT-AGGTTG
FAD3C'  (SEQ ID NO:20)  (969) GTCAACTTATG--AACC-GTTTT--ATTATTAGGTTG
FAD3A'' (SEQ ID NO:17) (1099) GTCAG-TTATG--AAC---TATTCAGGTGACGTTGG
FAD3C'' (SEQ ID NO:19) (1087) GTCAG-TTATG--AAC---TATTCAGGTAAATATTGG
FAD3C   (SEQ ID NO:18) (1064) GTCAG-TTATTAAACATGTTTT-AGCAA---TTT
                              1241                                    1280
FAD3A   (SEQ ID NO:15) (1063) TGCTTGTTGGTATTGTGACATTGCG-GTCATGGT
FAD3A'  (SEQ ID NO:16) (1007) TGATTAAACTTGCATTGT-ATACTT------GGTGCAAGT
FAD3C'  (SEQ ID NO:20) (1004) TGATTAAACTTCATTGTGATACTTGTTGGTTTAAAT
FAD3A'' (SEQ ID NO:17) (1133) TAGTGGTTGGTATTGTGACATTGGGTGTGGGT
FAD3C'' (SEQ ID NO:19) (1121) TAGTGGTTGGTATTGTGACATTGGGTGTGAGT
FAD3C   (SEQ ID NO:18) (1099) TGGTTGGTGGTATTGTGACATTGCG-GTGGGGT
```

```
                                  1441                                    1480
FAD3A   (SEQ ID NO:15)  (1192)  TTTAGCATCAAGAAAAAAGAA-ACAAACTTTATT--A
FAD3A'  (SEQ ID NO:16)  (1192)  TTTAGAACAAAGAAAAAGGAATCAAATTTTTATT-AA
FAD3C'  (SEQ ID NO:20)  (1193)  TTTAGAACAAAGAAAAAGGAATCAAACTTTAATT-AA
FAD3A'' (SEQ ID NO:17)  (1325)  TTTAGAAGCCAATAAAAAGAATCAAAACTTTATTTA
FAD3C'' (SEQ ID NO:19)  (1315)  TTTAGAGCCAATAAAAAGAATCAAACTTTCTT-AA
FAD3C   (SEQ ID NO:18)  (1228)  TTTAGCATCAAAAAAAAGAA-ACAAACTTTATT--A 1481                                    1520
FAD3A   (SEQ ID NO:15)  (1229)  ATGAATGGGCTATTTATGG-------TCAA--------
FAD3A'  (SEQ ID NO:16)  (1231)  ATGAATGGGTCTATGTCTTGG------TCATTATG
FAD3C'  (SEQ ID NO:20)  (1232)  ATGAATGGGCTATATCT-GG------TCATTATA
FAD3A'' (SEQ ID NO:17)  (1365)  ATGAAATGCGGCTATCTATTGGTCCTGACTCGGAC
FAD3C'' (SEQ ID NO:19)  (1354)  ATGAAATGCGGCTATCTATG--------TCGGAC
FAD3C   (SEQ ID NO:18)  (1265)  ATGAATGGGCTATTTATGG-------TCAA--------

1521                                    1560
FAD3A   (SEQ ID NO:15)  (1254)  --------A--TTAGCTATTATCAATGAC-AAGCCGG
FAD3A'  (SEQ ID NO:16)  (1264)  TAGCAAAATTTATTTAATTTATTCAACAGAAGCA
FAD3C'  (SEQ ID NO:20)  (1264)  TAGAAAAATTTATTTATAATATTTGAACAAAAGCA
FAD3A'' (SEQ ID NO:17)  (1405)  CATACATAC--TTAAGTATAATAGATATGATTTT
FAD3C'' (SEQ ID NO:19)  (1386)  CATAGATCA--TTAAGTATAATACATTAGATTTT
FAD3C   (SEQ ID NO:18)  (1290)  --------A--TTAGCTATTATCAATGAC-AAGCCGG 1561                                    1600
FAD3A   (SEQ ID NO:15)  (1283)  AA---------TAAATAATGT-A---------TAAGTTT
FAD3A'  (SEQ ID NO:16)  (1304)  AATTAATTATAATTAAATATCAATTATAATAATATT
FAD3C'  (SEQ ID NO:20)  (1304)  AATTAATTATAATTAAATATCAATTATAATAATATT
FAD3A'' (SEQ ID NO:17)  (1443)  TAAGGAA-TCACT-ATTATATTGATTACATCACTT
FAD3C'' (SEQ ID NO:19)  (1424)  TA--GGAA-TCACTATTATATTGATTACATCACTT
FAD3C   (SEQ ID NO:18)  (1319)  AA---------TAAATAATGT-AGCACATTGTGATTT
```

FIG. 3J

```
                              1601                              1640
FAD3A   (SEQ ID NO:15)  (1304) A_TAT----------------------AATATTTAA--A
FAD3A'  (SEQ ID NO:16)  (1344) _G_C_ATTATT__GGTTAGATATTTTAA_AATTA_TCA
FAD3C'  (SEQ ID NO:20)  (1344) ___C_ATTATT__GGTTAGATATTTGAA_AATTA_TCA
FAD3A'' (SEQ ID NO:17)  (1481) C_G_T_C_TCG___------------AA_ATTAC--A
FAD3C'' (SEQ ID NO:19)  (1461) C_____TC_TCG___------------AA_ACTTAC--A
FAD3C   (SEQ ID NO:18)  (1350) __T----------------------AATA_TTAA--A 1641                              1680
FAD3A   (SEQ ID NO:15)  (1319) TAT_T_T_TTT----------TAA_G_TTAT---TTT-_
FAD3A'  (SEQ ID NO:16)  (1384) T_ACT__GTTTAT_GAA-----CTC_TT_TA_CTTTTAA
FAD3C'  (SEQ ID NO:20)  (1384) T_ACT__G_TTAT_G_A___CTC_TT_TA_CTTTTA_
FAD3A'' (SEQ ID NO:17)  (1506) T_C_TCAATTCA__A_G_T___A_TT__C_-TTT_C
FAD3C'' (SEQ ID NO:19)  (1486) T_C_TCAATTCC__A_G_T___A_TTT_T---TTT_C
FAD3C   (SEQ ID NO:18)  (1363) TATT_T__CTT----------_AA_G__TTAT---TTT-_

1681                              1720
FAD3A   (SEQ ID NO:15)  (1346) TGTTA--------__T_GA_AC-----A_C__T_GAA_TA
FAD3A'  (SEQ ID NO:16)  (1419) TCTT_T---_TATTTC_CCA_TT__A__TG_GAAAC__
FAD3C'  (SEQ ID NO:20)  (1424) TCTT_T---_TATTTC_C_AT_TT__A_TTG_GAAAC__
FAD3A'' (SEQ ID NO:17)  (1545) TATT_CCGA_AC__T__T_AG_AG__AA___C_TAA_T
FAD3C'' (SEQ ID NO:19)  (1523) TATT_CTG-_AC__T__T_AT_AG_AAA____CAAA_T
FAD3C   (SEQ ID NO:18)  (1390) TGTTA--------__T_GA_AC-----A_C__T_GAA_T 1721                              1760
FAD3A   (SEQ ID NO:15)  (1374) __T------------ACGAAC__-GC_TCA_TT_CC_AGA
FAD3A'  (SEQ ID NO:16)  (1456) A_T_CAAAT__C_AT_AAGA_GGTCTT__GTA__AACAG
FAD3C'  (SEQ ID NO:20)  (1461) A_T_CAAAC__C_AT_AAA__GGTTT_C_GTA__AACA_
FAD3A'' (SEQ ID NO:17)  (1585) _TT_TTTG-__A_AA_AA__A-GA_TGGAT__A_AG
FAD3C'' (SEQ ID NO:19)  (1562) _TT_TTTG-__A_AA_AA_----GA_TGGAT__A_AG
FAD3C   (SEQ ID NO:18)  (1418) __T------------ACGAAC__-GC_TC_A_TT_CC_AGA
```

```
                                        1921                                    1960
FAD3A   (SEQ ID NO:15)  (1458) ----------------------------------------
FAD3A'  (SEQ ID NO:16)  (1653) A..CT....A.G.GTGAG...GTT.G.T....AA...T---
FAD3C'  (SEQ ID NO:20)  (1660) A..CT....A.G.GTGAG...GTT.G.T....AA...G.G
FAD3A'' (SEQ ID NO:17)  (1778) CC...GG....CC..C.GA.C.ATGG.C.TG.TG...
FAD3C'' (SEQ ID NO:19)  (1752) CC...GG....CC..C.GA.C.ATGG.C.TG.TG...
FAD3C   (SEQ ID NO:18)  (1564) G....AT.T.TTA..TT..A.A.AA..T.AG.A.C.

1961                                    2000
FAD3A   (SEQ ID NO:15)  (1458) ----------------------------------------
FAD3A'  (SEQ ID NO:16)  (1690) ---A.AA...A.G.AGA..AGT..GAATC.G.CA..AA.
FAD3C'  (SEQ ID NO:20)  (1700) A.AA.AA...A.G.AGA..GT..GAATC.G.CA..AA.
FAD3A'' (SEQ ID NO:17)  (1818) ..G.G.C.T.G..TCCGG..A.CTTTC.A..C.CG..
FAD3C'' (SEQ ID NO:19)  (1792) ..G.G.C.T.G..TCCGG..A.CTTTC.A..C.C..T
FAD3C   (SEQ ID NO:18)  (1604) .G.TTT..A.ACTC.TAT...G.ACCGT.TT.TA.T.TT 2001                                    2040
FAD3A   (SEQ ID NO:15)  (1458) ----------------------------------------
FAD3A'  (SEQ ID NO:16)  (1727) CAA.A..T.T.G-----------------------------
FAD3C'  (SEQ ID NO:20)  (1740) CAA.A.T.T.T.GG.GA.G.T..C.TT.GAC.G.G.CCG.A
FAD3A'' (SEQ ID NO:17)  (1858) ...T.TGTCT.T..T.T.T.T..T.TG.T.T.C.GAA.T
FAD3C'' (SEQ ID NO:19)  (1832) ...T.TGTCT.T..T.T.T.T..T.TG.T.T.G.GAA.T
FAD3C   (SEQ ID NO:18)  (1644) ...AGT..A.A..CA.GAG.CGA...T.A.TCCGC.A 2041                                    2080
FAD3A   (SEQ ID NO:15)  (1458) ----------------------------------------
FAD3A'  (SEQ ID NO:16)  (1740) ----------------------------------------
FAD3C'  (SEQ ID NO:20)  (1780) G.AA.T.T.GC..AGA..A.AT.GG.TGT.G.TG.A.A..
FAD3A'' (SEQ ID NO:17)  (1898) T.T..T..--..C.--.T.....T.AGG.T.CTAT.T.
FAD3C'' (SEQ ID NO:19)  (1872) C.T..T..--..C.--..AA.T..ATG.T.AT.G.A..
FAD3C   (SEQ ID NO:18)  (1684) AGAA..CC--ACC.--.G.AA..CTC.A.AA.C.T.C.
```

FIG. 3M

```
                                   2081                                    2120
FAD3A   (SEQ ID NO:15)  (1458)  ----------------------------------------
FAD3A'  (SEQ ID NO:16)  (1740)  ----------------------------------------
FAD3C'  (SEQ ID NO:20)  (1820)  G  C   - A A   TTT G  GAGACTTT GCT TAGT
FAD3A'' (SEQ ID NO:17)  (1934)  TA TT A A TT  GTT T GTCTG GC CA- ACCG
FAD3C'' (SEQ ID NO:19)  (1908)  C  AG  GG G  TAACGG ATATG GAACCT TCTC
FAD3C   (SEQ ID NO:18)  (1720)  C   G  C CTAAG AGGG C TTAACA AA AT------

2121                                    2160
FAD3A   (SEQ ID NO:15)  (1458)  ----------------------------------------
FAD3A'  (SEQ ID NO:16)  (1740)  ----------------------------------------
FAD3C'  (SEQ ID NO:20)  (1859)  TAA T G TGTAGCTGTA G  TAGG TGCAGA ATTT
FAD3A'' (SEQ ID NO:17)  (1973)  ACC C G C G------- T GTTTT TAG TG --AG
FAD3C'' (SEQ ID NO:19)  (1948)  TTA C T A CTAAAA-A G  AGAA CAG TT TAAA
FAD3C   (SEQ ID NO:18)  (1754)  --T AA A G-------- TA GTGTGGGC CAA----

2161                                    2200
FAD3A   (SEQ ID NO:15)  (1458)  ----------------------------------------
FAD3A'  (SEQ ID NO:16)  (1740)  ----------------------------------------
FAD3C'  (SEQ ID NO:20)  (1899)  TAAAATATGTA  A ATGTG GCATG  TA ATA
FAD3A'' (SEQ ID NO:17)  (2004)  --------  - TTGCA G GTAA   CAG
FAD3C'' (SEQ ID NO:19)  (1987)   G GTTTATG  CG TCTTA   TTTT   AAA
FAD3C   (SEQ ID NO:18)  (1781)  -  --------  AAAACCGG ACAAA  CGCG 2201                                    2240
FAD3A   (SEQ ID NO:15)  (1458)  ----------------------------------------
FAD3A'  (SEQ ID NO:16)  (1740)  ----------------------------------------
FAD3C'  (SEQ ID NO:20)  (1939)   AT TT TATT  TATCACTTAAAAT- ATTTA A
FAD3A'' (SEQ ID NO:17)  (2035)  C TA TTG  TTG------------- AG A
FAD3C'' (SEQ ID NO:19)  (2027)   GTT GA A GGG CTTATATTCCGCTA AA C C
FAD3C   (SEQ ID NO:18)  (1812)   AG GG  GAT------------- T GT T A
```

FIG. 3N

```
                                    2241                                    2280
FAD3A   (SEQ ID NO:15)  (1458)  ----------------------------------------
FAD3A'  (SEQ ID NO:16)  (1740)  ----------------------------------------
FAD3C'  (SEQ ID NO:20)  (1978)  AA  TTTTTTAA  TTATCAAAGTTTACTGTTATTTAAAA
FAD3A'' (SEQ ID NO:17)  (2060)   CA A -----C  ------------------------
FAD3C'' (SEQ ID NO:19)  (2067)   C  A AACCCC  TAATCATACTC--CTAGGATTCTATA
FAD3C   (SEQ ID NO:18)  (1838)   T GT  ---------------------------------

2281                                    2320
FAD3A   (SEQ ID NO:15)  (1458)  ----------------------------------------
FAD3A'  (SEQ ID NO:16)  (1740)  ----------------------------------------
FAD3C'  (SEQ ID NO:20)  (2018)  TGTGAT G A A A C T  ATTTAAAATATTTCAA
FAD3A'' (SEQ ID NO:17)  (2069)  ------ CT  TA T   A ATACA -TT-------
FAD3C'' (SEQ ID NO:19)  (2105)  TGTT-T T  T G   TG  TTCA CTGAGGTCAG
FAD3C   (SEQ ID NO:18)  (1844)  ------C G  TG GGA CCC C GGTG ----------

2321                                    2360
FAD3A   (SEQ ID NO:15)  (1458)  ----------------------------------------
FAD3A'  (SEQ ID NO:16)  (1740)  ----------------------------------------
FAD3C'  (SEQ ID NO:20)  (2058)  TAATTTAAAAGCACCCAAAAT AGAG AAAATATTT T G
FAD3A'' (SEQ ID NO:17)  (2095)  ---------TT--------T TCT ---------  A A
FAD3C'' (SEQ ID NO:19)  (2144)  ACCGGCCACTTGTCAGATCT  TTT  AGCTGTAGT A A
FAD3C   (SEQ ID NO:18)  (1868)  --------------------G CCG G--------- TTG 2361                                    2400
FAD3A   (SEQ ID NO:15)  (1458)  ----------------------------------------
FAD3A'  (SEQ ID NO:16)  (1740)  ----------------------------------------
FAD3C'  (SEQ ID NO:20)  (2098)   TGTT  TTATTATG T TC TATT--  T A A
FAD3A'' (SEQ ID NO:17)  (2109)   AGAA  --------  AA A --------    AG
FAD3C'' (SEQ ID NO:19)  (2184)   ACAA  GCAAGTGT A  G  CAGCGG  A    G
FAD3C   (SEQ ID NO:18)  (1880)  GTTTC  --------TT  A  ------  A T T
```

FIG. 3O

```
                              2401                                    2440
FAD3A   (SEQ ID NO:15)  (1458) ----------------------------------------
FAD3A'  (SEQ ID NO:16)  (1740) ----------------------------------------
FAD3C'  (SEQ ID NO:20)  (2136) AAAATATTTTTGTTCTTACAGTTTCTACGCTTTAA
FAD3A'' (SEQ ID NO:17)  (2132) TGAGGACG---------------------ACTCTTT
FAD3C'' (SEQ ID NO:19)  (2224) CCGATCTTCTCAAAAAAATTTTATACTCTTTT
FAD3C   (SEQ ID NO:18)  (1906) TTAATCGG---------------------GAAAAATT
                              2441                                    2480
FAD3A   (SEQ ID NO:15)  (1458) ----------------------------------------
FAD3A'  (SEQ ID NO:16)  (1740) ----------------------------------------
FAD3C'  (SEQ ID NO:20)  (2176) AAAGATGTAAGTTGAACTAATAAAGAA-----
FAD3A'' (SEQ ID NO:17)  (2153) AAC-----------ACTCTCAACC-AATTT
FAD3C'' (SEQ ID NO:19)  (2264) AAGATTTTTTGTTTCAATGAACCGAACTT
FAD3C   (SEQ ID NO:18)  (1927) AAA----------C-----AAACGTT-----AA
                              2481                                    2520
FAD3A   (SEQ ID NO:15)  (1458) ----------------------------------------
FAD3A'  (SEQ ID NO:16)  (1740) ----------------------------------------
FAD3C'  (SEQ ID NO:20)  (2213) -AAGTTGGTTTTTTTGAGCTTTTTA
FAD3A'' (SEQ ID NO:17)  (2181) GATCATCTTTAATAATTGACAAAT
FAD3C'' (SEQ ID NO:19)  (2304) CATGAAGTTTTTTCAATTGACAAAT
FAD3C   (SEQ ID NO:18)  (1949) TCTGGCCTCAGTGGGGTAGATATTCGATA
                              2521                                    2560
FAD3A   (SEQ ID NO:15)  (1458) ----------------------------------------
FAD3A'  (SEQ ID NO:16)  (1740) ----------------------------------------
FAD3C'  (SEQ ID NO:20)  (2252) -AGTAAGCAG-AAGGTAAAAATAGAAATTG
FAD3A'' (SEQ ID NO:17)  (2221) TAATCAACTAGACAAGTATTC
FAD3C'' (SEQ ID NO:19)  (2344) TATCCGACCTAAACAAGTATTC
FAD3C   (SEQ ID NO:18)  (1989) GACCCTCAAAACCCCGAAACTGCCAC
```

FIG. 3P

```
                                        2561                              2600
FAD3A   (SEQ ID NO:15)  (1460)  ACGCC--------TCAAAACG----ATACTTATGAC
FAD3A'  (SEQ ID NO:16)  (1740)  ----------------------------------------
FAD3C'  (SEQ ID NO:20)  (2290)  GTAGACTTAATTTTCAAAGT----AAACTAAAGCT
FAD3A'' (SEQ ID NO:17)  (2261)  TTTTGTTTAATTTAAAATTTTTTCATCATAAT
FAD3C'' (SEQ ID NO:19)  (2384)  TTTCGTTTAATTTAAAATTTTTGATATAAT
FAD3C   (SEQ ID NO:18)  (2029)  ACTGCT--------TCAAAATG----ATACTTATGAC 2601                              2640
FAD3A   (SEQ ID NO:15)  (1488)  AATCCAA----TTCAT--TTT-----------
FAD3A'  (SEQ ID NO:16)  (1740)  ----------------------------------------
FAD3C'  (SEQ ID NO:20)  (2326)  GATGGTAAAGTTAAGATTAGAAA--AAAATAAGCT
FAD3A'' (SEQ ID NO:17)  (2301)  ATCCAA----TTGTT--TTATAATTCAAATTTACA
FAD3C'' (SEQ ID NO:19)  (2424)  ATCCAA----TTGTT--TTATAATTCAAATTTATA
FAD3C   (SEQ ID NO:18)  (2057)  AATCCAA----TTCAT--TT------------

2641                              2680
FAD3A   (SEQ ID NO:15)  (1505)  --------ATGAAA---TTA--AA----------AA
FAD3A'  (SEQ ID NO:16)  (1740)  ---------------------------------AC
FAD3C'  (SEQ ID NO:20)  (2364)  AAAGTAGTAGATAAACCCACCAACACCTCCATGGAC
FAD3A'' (SEQ ID NO:17)  (2336)  CAAAAACTAATAAATTT--AA----------AA
FAD3C'' (SEQ ID NO:19)  (2459)  CTAAAACTAATAAATGTT--AA----------AA
FAD3C   (SEQ ID NO:18)  (2074)  --------ATGAAA---TAA--AA----------AA 2691                              2720
FAD3A   (SEQ ID NO:15)  (1521)  TAGTT----TATTT--------TATAATTCGGGTGG----
FAD3A'  (SEQ ID NO:16)  (1742)  AATTAATTTTATGTAAACACAT---TTAAAATTCAG-
FAD3C'  (SEQ ID NO:20)  (2404)  AATTAATTTTATGTAAACATATTTAAAATTCAG-
FAD3A'' (SEQ ID NO:17)  (2363)  GATTTTAATATTTAAAA-TATAATTTGCAAAAAAA
FAD3C'' (SEQ ID NO:19)  (2486)  GATTTTAATATTT-AAGAC-TATAATTACACAAA-
FAD3C   (SEQ ID NO:18)  (2090)  TAGTT----TATTT-------TATACTGAGGGTGG----
```

FIG. 3Q

```
                                    2721                              2760
FAD3A   (SEQ ID NO:15) (1546) --TTCACAA------GAATAAG----------GATCGG
FAD3A'  (SEQ ID NO:16) (1779) -GCTCACAA------GAATAAG----------GATCG
FAD3C'  (SEQ ID NO:20) (2443) -GCTCACAA------GAATAAG----------GATCG
FAD3A'' (SEQ ID NO:17) (2402) TATTACAAAA-AAATGTAATAA---AAACTTTAAAATAAG
FAD3C'' (SEQ ID NO:19) (2523) TATTACAAAGAAATGTAATAATAAAAATTTAAAATAAG
FAD3C   (SEQ ID NO:18) (2115) --TTCACAA------GAATAAG----------GATCGG 2761                              2800
FAD3A   (SEQ ID NO:15) (1568) AAGACCAC---CAGAAGATGCCAGTTGAAA-----AC
FAD3A'  (SEQ ID NO:16) (1802) AAGACCAC---CAGAAGATGCCAGTTGAAA-----AC
FAD3C'  (SEQ ID NO:20) (2466) AAGACCAC---CAGAAGATGCCAGTTGAAA-----AC
FAD3A'' (SEQ ID NO:17) (2438) ATATATGAAGACATAATTATTAGAAATTTAAATATTATA
FAD3C'' (SEQ ID NO:19) (2563) ATAATGAAGACATAATTATTAGAAATTTAAATATTATA
FAD3C   (SEQ ID NO:18) (2137) AAGACCAC---CAGAAGATGCCAGTTGAAA-----AC 2801                              2840
FAD3A   (SEQ ID NO:15) (1602) ACGATTTGCTCGGTAA------TC-----CCCGC
FAD3A'  (SEQ ID NO:16) (1836) ACGATTTGCTCGGTAACAG--TC-----CCTCT
FAD3C'  (SEQ ID NO:20) (2500) ACGATTTGCTCGGTAACAG--TC------CCTCT
FAD3A'' (SEQ ID NO:17) (2478) ACAATATTAATAATCTGGTAAATGGCTCCAAAACCGCAA
FAD3C'' (SEQ ID NO:19) (2603) ACAATATTAATAATCTGGTAAATGGCTCTGGAACCTCA
FAD3C   (SEQ ID NO:18) (2171) ACGATTTGCTCGGTAA------TCTTTC-CCCGC 2841                              2880
FAD3A   (SEQ ID NO:15) (1631) GCAT-----------------------ATTTTTT------
FAD3A'  (SEQ ID NO:16) (1869) AATA---------AAT--------TCTATTTGCG--------
FAD3C'  (SEQ ID NO:20) (2533) AATA---------AAT--------TCTATTTGCG---T--
FAD3A'' (SEQ ID NO:17) (2518) AAATTCTAAATTATGGTCCAAACAAATTT-GGGAACCG
FAD3C'' (SEQ ID NO:19) (2643) AAAT---------ATGGTCTAAACAAATTTGGGAACCG
FAD3C   (SEQ ID NO:18) (2204) GCAT---------------------ATTTTTTT-----
```

FIG. 3R

```
                                         2881                                    2920
    FAD3A   (SEQ ID NO:15)  (1645) ------------------CTTTTTTGAAAC--------
    FAD3A'  (SEQ ID NO:16)  (1888) ---------GTCAAATATTGTTTTCCGAAATTGAG
    FAD3C'  (SEQ ID NO:20)  (2554) ---------GTCAAATATTGTTTTCCGAAATTGAG
    FAD3A'' (SEQ ID NO:17)  (2557) AATATGGAGCATTCGAAATAATTTAGGAAAGTGT
    FAD3C'' (SEQ ID NO:19)  (2675) AAGATGGAGCATTCGAAATAATTTAGGAAAATTG
    FAD3C   (SEQ ID NO:18)  (2217) --------------------CTTTTTTGAAA------

2921                                    2960
    FAD3A   (SEQ ID NO:15)  (1659) -----------------T---CTTCATTTTATATGT-
    FAD3A'  (SEQ ID NO:16)  (1919) CCAGAACAACCACTTGACAA-TTTGATT-TTAGCTGTA
    FAD3C'  (SEQ ID NO:20)  (2585) CCAGAACAACCACTTGACAG-TTTGATT-TCAGCTGTA
    FAD3A'' (SEQ ID NO:17)  (2597) GTATTTTACTTGTAGTA-AATATTTAATTAGAATTGT
    FAD3C'' (SEQ ID NO:19)  (2715) GTATTTTACTTCTAGTATAATATTTAATTAAAATTGT
    FAD3C   (SEQ ID NO:18)  (2231) -----------------T---CTTCATTTTATATGT- 2961                                    3000
    FAD3A   (SEQ ID NO:15)  (1678) --AGAATCTATTATT----------ATTAATC
    FAD3A'  (SEQ ID NO:16)  (1957) GAAAAACAGTTTCTAGTGTCACAGTAACCGGTAATAG
    FAD3C'  (SEQ ID NO:20)  (2623) GAAAAACAGTTTCTAGTGTCACAGTAACCGGTAATAG
    FAD3A'' (SEQ ID NO:17)  (2636) TAATAATTTTAAATTAATGTAAGATTTATTTAATA
    FAD3C'' (SEQ ID NO:19)  (2755) TAATAATTTTAAATTAATGTAAATTTAATTAATA
    FAD3C   (SEQ ID NO:18)  (2250) --AGGATCTATTGATT----------ATTAATC 3001                                    3040
    FAD3A   (SEQ ID NO:15)  (1705) ATCAT-------------------------------
    FAD3A'  (SEQ ID NO:16)  (1997) ATTATTTTTAGCGAATAGAGAAGAACAATTTAGAAAA
    FAD3C'  (SEQ ID NO:20)  (2663) ATTATTTTTAGCGAATAGAGAAGAACAATTTAGAAAA
    FAD3A'' (SEQ ID NO:17)  (2676) ATATTACAGTAATAATTATATTAGTACAAGAATTAT
    FAD3C'' (SEQ ID NO:19)  (2795) ATATTACAGTAATAATTATATTAGTGCAAGAATTAT
    FAD3C   (SEQ ID NO:18)  (2277) ATCAT-------------------------------
```

FIG. 3S

```
                                    3041                                    3080
FAD3A   (SEQ ID NO:15)  (1710)  -----TTT--------------------------------
FAD3A'  (SEQ ID NO:16)  (2037)  T  ATATAC  TATGG  G G CAACGG  C CGC T
FAD3C'  (SEQ ID NO:20)  (2703)  T  ATATAC  AATAG  G G CAACGG  C CGCCT
FAD3A'' (SEQ ID NO:17)  (2716)  A  G TTT - AGATT G A T GTTATA  A AAA A
FAD3C'' (SEQ ID NO:19)  (2835)  A TTTTT T GGATT  A T G----AC ATGAT A
FAD3C   (SEQ ID NO:18)  (2282)  -----TTT--------------------------------

3081                                    3120
FAD3A   (SEQ ID NO:15)  (1714)  ------------------------------C-------AG G
FAD3A'  (SEQ ID NO:16)  (2077)  TTT T  G G TC TTT  T C- C--CC - AA
FAD3C'  (SEQ ID NO:20)  (2743)  TTT T C G G TC TCT  T C- T---CC - A
FAD3A'' (SEQ ID NO:17)  (2755)  GGATC    TGT  AA ACA  A TT TGAAA TA
FAD3C'' (SEQ ID NO:19)  (2871)  CCC G G TC T GAG G-------GAGT TTA
FAD3C   (SEQ ID NO:18)  (2286)  ------------------------------C-------A 3121                                    3160
FAD3A   (SEQ ID NO:15)  (1720)  GAG C T -------------------------------
FAD3A'  (SEQ ID NO:16)  (2113)  TATT T  TTGC GATTT G T TA GCAC T GA T A
FAD3C'  (SEQ ID NO:20)  (2779)  TATT T  TTAC GTTTT G T TA ACAC T GA T C
FAD3A'' (SEQ ID NO:17)  (2795)  A A  TTTGGTT TGAAA A A AC TTGA ACTT A A
FAD3C'' (SEQ ID NO:19)  (2900)  AA C TT----------AAGA ACAG TTCTTA CT CCG
FAD3C   (SEQ ID NO:18)  (2292)  GAG CT -------------------------------

3161                                    3200
FAD3A   (SEQ ID NO:15)  (1729)  ----------- ---A A AC TC AGAT TG  --
FAD3A'  (SEQ ID NO:16)  (2153)  TA A A TA-------TT T CA AT TTCAAA TA AACAC
FAD3C'  (SEQ ID NO:20)  (2819)  AA A A TAAAATATT T   AT TT AAA TA AACAT
FAD3A'' (SEQ ID NO:17)  (2835)  TTT G GTTTT CAAA T TA AA TA TAG A TT
FAD3C'' (SEQ ID NO:19)  (2930)  GT  G ACC---CCA  C  AAGAATCC A GT   ---
FAD3C   (SEQ ID NO:18)  (2301)  ---------- ---A A C TT CAGAT TG  --
```

FIG. 3T

```
                                        3201                                3240
FAD3A   (SEQ ID NO:15)  (1753)  -------N--------NTANCNNTNG----------------
FAD3A'  (SEQ ID NO:16)  (2188)  CATNAC-NTNNANACTAANCATNTNTCANCCNTAANNN
FAD3C'  (SEQ ID NO:20)  (2859)  CACNAA-NTNNANCCTAANAATNTNTTANCCNTAANNN
FAD3A'' (SEQ ID NO:17)  (2875)  TTTNTGGAGNNGNNTNTANTGNTTANGGTNGTNNCTCNG-
FAD3C'' (SEQ ID NO:19)  (2964)  ---------NNGNTCNTANTNATNA-----------CNN
FAD3C   (SEQ ID NO:18)  (2325)  -------N--------NTANCNNTNG----------------

3241                                3280
FAD3A   (SEQ ID NO:15)  (1764)  ----------------------------------------
FAD3A'  (SEQ ID NO:16)  (2227)  --TAANTTNGAAANNNATNANTATAAATTNTGTANGAAN
FAD3C'  (SEQ ID NO:20)  (2898)  A-TAANCTNGAAANNNATNANCATAATTNTACANGAAN
FAD3A'' (SEQ ID NO:17)  (2915)  AAATGNAANATCTNNN-NTNATACTCCCNCCGTNNTTT
FAD3C'' (SEQ ID NO:19)  (2984)  TAAGGNTCNTTGTGNNA------------------------N
FAD3C   (SEQ ID NO:18)  (2336)  ----------------------------------------

3281                                3320
FAD3A   (SEQ ID NO:15)  (1764)  ----------------------------------------
FAD3A'  (SEQ ID NO:16)  (2265)  TNNNNNATAANACTTNTNTTANANNNNAN------N
FAD3C'  (SEQ ID NO:20)  (2937)  TNNNNNACGANACTTNTNTTANANCANNANTT----N
FAD3A'' (SEQ ID NO:17)  (2955)  ANNNNNGTCGTNTTACNGNATNCNNTNGANTAAGAAN
FAD3C'' (SEQ ID NO:19)  (3002)  ANNCNNNTAATNTTGANCNNATGTTTNNNGNNNG-------
FAD3C   (SEQ ID NO:18)  (2336)  ----------------------------------------

3321                                3360
FAD3A   (SEQ ID NO:15)  (1764)  --------------------T-----AAACAACTG---
FAD3A'  (SEQ ID NO:16)  (2299)  TTTACNNCGANAATNNAACNGANACGNNAANGANNTNANTN
FAD3C'  (SEQ ID NO:20)  (2973)  TTTACNNCGANAATNNANTGANACGNNAGNAGTTNANTN
FAD3A'' (SEQ ID NO:17)  (2995)  CCATTNNTTTNTTANNTTNCTNGACANNNCNTNATNAN
FAD3C'' (SEQ ID NO:19)  (3036)  -------------------TTNNC---GAANNANNCNNTNG
FAD3C   (SEQ ID NO:18)  (2336)  ---------------------T----ANNANNNG---
```

FIG. 3U

```
                              3361                                    3400
FAD3A   (SEQ ID NO:15)  (1774) --A TTA---------------------------------
FAD3A'  (SEQ ID NO:16)  (2339) A C TTAAT  AG GTT  T-------G     TT
FAD3C'  (SEQ ID NO:20)  (3013) T CTTAAT  AG GTT TT------ A   AT
FAD3A'' (SEQ ID NO:17)  (3035) T   TTACC  CC CAA  CAACCAA T    TA
FAD3C'' (SEQ ID NO:19)  (3058) AAC TTA----------------AA TT G GT---
FAD3C   (SEQ ID NO:18)  (2346) --  TTA---------------------------------

3401                                    3440
FAD3A   (SEQ ID NO:15)  (1779) ----------------------------------AA GTT  G
FAD3A'  (SEQ ID NO:16)  (2372)  GA ATG TTATGC AAAC CAT TGAAA TC TTG A T
FAD3C'  (SEQ ID NO:20)  (3048)  GA ATG TTATGC AAAC CAT TGAAA TC TTC A T
FAD3A'' (SEQ ID NO:17)  (3075) GATATAT ACCATT GTCA ACAACATT A  ATTA  A
FAD3C'' (SEQ ID NO:19)  (3077)  CT TAT ---------- AGA ----- A TTTTT
FAD3C   (SEQ ID NO:18)  (2351) ----------------------------------AA GTT 3441                                    3480
FAD3A   (SEQ ID NO:15)  (1791) ---- A  -------------------------------
FAD3A'  (SEQ ID NO:16)  (2412)  ATAGAT  T GT T A T TTT A AT T CTT------
FAD3C'  (SEQ ID NO:20)  (3088)  AAA AT  T GT T A TTTTT A AT T CA------
FAD3A'' (SEQ ID NO:17)  (3115)  TTT A A A -A A CCG AAA G CA A AATTGGAA
FAD3C'' (SEQ ID NO:19)  (3102)  GGT A GCA TA CTC C AAATC ----------
FAD3C   (SEQ ID NO:18)  (2363) ---- A  -------------------------------

3481                                    3520
FAD3A   (SEQ ID NO:15)  (1795) ----------------------------------------
FAD3A'  (SEQ ID NO:16)  (2446) ------ AAA A A AATT TATAT A TATA T------
FAD3C'  (SEQ ID NO:20)  (3121) ------ AAA A A AATT TAA T A ATA TATAAT----
FAD3A'' (SEQ ID NO:17)  (3154) CAAAA  T TC CTAA ACG C T   T AAAAACGGA
FAD3C'' (SEQ ID NO:19)  (3128) ----A  TCT ---------- C TT  -----------
FAD3C   (SEQ ID NO:18)  (2367) ----------------------------------------
```

FIG. 3V

```
                      3521                                    3560
FAD3A   (SEQ ID NO:15) (1795) ----T---TAGTTAACTTTACAACTGCCACTTATAT
FAD3A'  (SEQ ID NO:16) (2473) ----TTGTGATAAAATCTCGTCAAAACTCACTAATGCAA
FAD3C'  (SEQ ID NO:20) (3153) ----TTGTGATAAAATCTCGTCAAAACTCACTAATGCAA
FAD3A'' (SEQ ID NO:17) (3194) GGGAGTAGTACCTAATTTACGATTGTCACTTATAT
FAD3C'' (SEQ ID NO:19) (3145) ------AGTACCTAATTTTCGATTGTCACTTATAT
FAD3C   (SEQ ID NO:18) (2367) ----T---TAGTTAACTTTACAACTGCCACTTATAT 3561                                    3600
FAD3A   (SEQ ID NO:15) (1828) CAGCTATTGT-TATAAATCATT-CTTCTCGAAATTCTTT
FAD3A'  (SEQ ID NO:16) (2509) ATGTTTTAT-TTTGATTTCTTACTTCTCTAAATGCATT
FAD3C'  (SEQ ID NO:20) (3189) ATGTTTTATATTTGAGTTTCTTACTTCTCTAAATGCATT
FAD3A'' (SEQ ID NO:17) (3234) TGTTCTTAG-TATAAATCATT-CTTCTCGAAATCCTTT
FAD3C'' (SEQ ID NO:19) (3179) TGTTCTTAG-TATAACTCATT-CTTCTCGAAATCCTTT
FAD3C   (SEQ ID NO:18) (2400) CAGCTATTGT-TATAAATCATT-CTTCTCGAAATTCTTT 3601                                    3640
FAD3A   (SEQ ID NO:15) (1866) TACTTTTCT--TGTATT-TTT-------CATTTTGTAG
FAD3A'  (SEQ ID NO:16) (2548) TACTTTTATACTATATTATTTGTTCTCTAATTTGTG
FAD3C'  (SEQ ID NO:20) (3229) TACTTTATACTTTATTATTTGTTCTCTAATTTGTTG
FAD3A'' (SEQ ID NO:17) (3272) TACTTTCTT--CTTATT-TTTGCTTTCATTTTGTG
FAD3C'' (SEQ ID NO:19) (3217) TACTTTCTT--CGTATT-TTTGCTTTCATTTTGTG
FAD3C   (SEQ ID NO:18) (2438) TACTTTTCT--TGTATT-TTT-------CAATTTGTAG 3641                                    3680
FAD3A   (SEQ ID NO:15) (1896) TTTACGTAGAACTAA------TT-------AAAG-------
FAD3A'  (SEQ ID NO:16) (2588) TTT-CGTAATAGTTTG---TCTGTATTTTGAAAACTA----
FAD3C'  (SEQ ID NO:20) (3269) TTTTCGTAATAGTTTG---TCTGTGTTTTGAAAACTA----
FAD3A'' (SEQ ID NO:17) (3309) TTTTCGTAATACTTGGTTTCATTCTGAAACTTTAG
FAD3C'' (SEQ ID NO:19) (3254) TTTTCGTAATACTTGGTTGCATCTGAAACTTTAG
FAD3C   (SEQ ID NO:18) (2468) TTTACGTAGAACTAA------TT-------AAAG-------
```

FIG. 3W

|                       |          | 3681                                        | 3720 |
|---|---|---|---|
| FAD3A  (SEQ ID NO:15) | (1918)   | -AAAAAACTTATAAACACC----------------------- | |
| FAD3A' (SEQ ID NO:16) | (2621)   | -ACAAAAATAATAAAACAAA---------AGCTTTA        | |
| FAD3C' (SEQ ID NO:20) | (3303)   | -ACAAAAATAATAAAACAAA---------AGTTTTA        | |
| FAD3A''(SEQ ID NO:17) | (3349)   | TATAAAACTTATAAACATACATGCAATGAATTTAT         | |
| FAD3C''(SEQ ID NO:19) | (3294)   | TATAAA-CTTATAAACAT---------GAATTTAT         | |
| FAD3C  (SEQ ID NO:18) | (2490)   | -AAAA--ACTTATAAACACC----------------------- | |

|                       |          | 3721                                        | 3760 |
|---|---|---|---|
| FAD3A  (SEQ ID NO:15) | (1939)   | -------------------------ACATGCAATGAATA---- | |
| FAD3A' (SEQ ID NO:16) | (2651)   | ---ACACAT-----------A-GAATGCAATGAATAG-      | |
| FAD3C' (SEQ ID NO:20) | (3333)   | ---ACACAT-----------A-GAATGCAATGAAT---      | |
| FAD3A''(SEQ ID NO:17) | (3389)   | CGAATACAAACCAGAATGACAATTTTCAATGAATATT        | |
| FAD3C''(SEQ ID NO:19) | (3323)   | CGAATACAAACCAGAATGACAATTTTCAATGAATATT        | |
| FAD3C  (SEQ ID NO:18) | (2509)   | -------------------------ACATGCAATGAATA---- | |

|                       |          | 3761                                        | 3800 |
|---|---|---|---|
| FAD3A  (SEQ ID NO:15) | (1953)   | AATGATAATAA----ACATACTGATAA--------          | |
| FAD3A' (SEQ ID NO:16) | (2674)   | TACGAATATATATACAAACTA-TCAAGACATTT            | |
| FAD3C' (SEQ ID NO:20) | (3353)   | --------ATAATATCAAACTA-TCAAGACATTT           | |
| FAD3A''(SEQ ID NO:17) | (3429)   | AATACAGTAAGTACTTCACCGTAATAGTATAGAAAG         | |
| FAD3C''(SEQ ID NO:19) | (3363)   | AATATGTAAGTACTTCACCGTAATAGTAA-----AAG        | |
| FAD3C  (SEQ ID NO:18) | (2523)   | AATTGATATATAA----ACATACTGATAA--------        | |

|                       |          | 3801                                        | 3840 |
|---|---|---|---|
| FAD3A  (SEQ ID NO:15) | (1981)   | ---AATAAT----------------A----AA---          | |
| FAD3A' (SEQ ID NO:16) | (2713)   | ACCAAGTACT----A-----------AATTGATAC          | |
| FAD3C' (SEQ ID NO:20) | (3385)   | AGCAAGTACT----A-----------AATTGATAC          | |
| FAD3A''(SEQ ID NO:17) | (3469)   | ACAAATAATTTTATTTTGTCATCAAACAAAGTATAG         | |
| FAD3C''(SEQ ID NO:19) | (3398)   | AAAAGTAAT-----------------AGTATAG            | |
| FAD3C  (SEQ ID NO:18) | (2551)   | ---AATAAT-------------------A----T---        | |

FIG. 3X

|  |  |  | 3841 | 3880 |
|---|---|---|---|---|
| FAD3A | (SEQ ID NO:15) | (1991) | -AATTTAATCTTAATTTTCATTCCAGTTACCAGAAAAA | |
| FAD3A' | (SEQ ID NO:16) | (2736) | AAAATTCATTTAATTGTTCCTTCAGTTACCAGAAAG | |
| FAD3C' | (SEQ ID NO:20) | (3408) | AAAATTCATTTAATTGTTCCTTCAGTTACCAGAAAA | |
| FAD3A'' | (SEQ ID NO:17) | (3509) | AAATTAATATAATTATTTTTCAGTTCCAGAAA | |
| FAD3C'' | (SEQ ID NO:19) | (3416) | AAATTAATATAATTATTTTTCAGTTCCAGAAA | |
| FAD3C | (SEQ ID NO:18) | (2561) | -AATTTAATCTAATTTTCTTCCAGTTCCAGAAAAA | |

|  |  |  | 3881 | 3920 |
|---|---|---|---|---|
| FAD3A | (SEQ ID NO:15) | (2030) | TTATACAAGAATTTCCCAAGTACACGGATGCTCAGAT | |
| FAD3A' | (SEQ ID NO:16) | (2776) | TTATACAAGAATTACCCACAGTACCGGATGCTCAGAT | |
| FAD3C' | (SEQ ID NO:20) | (3448) | TTATACAAGATTTACCCACAGTACCGGATGCTCAGAT | |
| FAD3A'' | (SEQ ID NO:17) | (3549) | TTGTACAAGACTTCCCCATAGTACCGGATGCTCAGAT | |
| FAD3C'' | (SEQ ID NO:19) | (3456) | TTGTACAAGACTTCCCCATAGTACCGGATGCTCAGAT | |
| FAD3C | (SEQ ID NO:18) | (2600) | TTATACAAGAATTTCCCAAGTACACGGATGCTCAGAT | |

|  |  |  | 3921 | 3960 |
|---|---|---|---|---|
| FAD3A | (SEQ ID NO:15) | (2070) | ACACTGTCCTCTCCCCATGCTCGCTTACCCTCTCTATCT | |
| FAD3A' | (SEQ ID NO:16) | (2816) | ACACTGTCCTCTCCCATGCTCGCTTACCCATCTATCT | |
| FAD3C' | (SEQ ID NO:20) | (3488) | ACACTGTCCTCTCCCATGCTCGCTTACCCATCTATCT | |
| FAD3A'' | (SEQ ID NO:17) | (3589) | ACACTGTTCCTCTCCCATGCTCGCTTACCCATCTATCT | |
| FAD3C'' | (SEQ ID NO:19) | (3496) | ACACTGTCCTCTCCCATGCTCGCTTACCCATCTATCT | |
| FAD3C | (SEQ ID NO:18) | (2640) | ACACTGTCCTCTCCCCATGCTCGCTTACCCTCTCTATCT | |

|  |  |  | 3961 | 4000 |
|---|---|---|---|---|
| FAD3A | (SEQ ID NO:15) | (2110) | GGTAATCCTAATTCCTCATTTGTCTTCCTGATTATAAC | |
| FAD3A' | (SEQ ID NO:16) | (2856) | GGTAT--------------TTTAATTCTAAATTAC | |
| FAD3C' | (SEQ ID NO:20) | (3528) | GGTAT--------------TTTAATTCTAAAACTACC | |
| FAD3A'' | (SEQ ID NO:17) | (3629) | GGTAAAAAA-TACATTCATTTTTTCAAAA | |
| FAD3C'' | (SEQ ID NO:19) | (3536) | GGTAAAAA--TACATTCCTTTTT-CAAAA | |
| FAD3C | (SEQ ID NO:18) | (2680) | GGTAATCCTATTCCTAATTCTCTTCTGATAAA | |

FIG. 3Y

```
                                        4001                                    4040
FAD3A   (SEQ ID NO:15)  (2150)  ACAA TTTGAATTTTTA A T TG GTATTAA--  T  AT
FAD3A'  (SEQ ID NO:16)  (2883)  ACAAGT----C TTTTA AC--TGTGT TTAA--A C AT
FAD3C'  (SEQ ID NO:20)  (3555)  ACAA T----C TTTTA A --TGTGT TTAA--A C AT
FAD3A'' (SEQ ID NO:17)  (3668)  ACAAAT----GGTTTTATA  TG GT TTAAGC  TAT
FAD3C'' (SEQ ID NO:19)  (3573)  ACAAAT----G TTTTATA  TG GT TTAAGC  TAT
FAD3C   (SEQ ID NO:18)  (2720)  ACAA TTTGAATTTTTA A TG GTATTAA--  T  AT 4041                                    4080
FAD3A   (SEQ ID NO:15)  (2188)  ATAA TTA A ATTT TTT G GATGA-CT CAGTGGTACAG
FAD3A'  (SEQ ID NO:16)  (2915)  ATAA-TTAT TTT G-TTG  T A-CTGCAGTGGTACAG
FAD3C'  (SEQ ID NO:20)  (3587)  ATAA TTAT TTTCTTTG  T A-CTGCAGTGGTACAG
FAD3A'' (SEQ ID NO:17)  (3704)  ATAA TTA  TTT ATT GA  T AACT CAGTGGTACAG
FAD3C'' (SEQ ID NO:19)  (3609)  ATAA TTA  TTT ATT GA  T AACT CAGTGGTACAG
FAD3C   (SEQ ID NO:18)  (2758)  ATAA TTA A TTT TTT G GATGA-CT CAGTGGTACAG 4081                                    4120
FAD3A   (SEQ ID NO:15)  (2227)  AAGTCCTGGTAAAGAAGGGTCACATTATAACCCATACAGT
FAD3A'  (SEQ ID NO:16)  (2952)  AAGTCCTGG AAAGAAGGGTCACATT TAACCCATACAGT
FAD3C'  (SEQ ID NO:20)  (3626)  AAGTCCTGG AAAGAAGGGTCACATT TAACCCATACAGT
FAD3A'' (SEQ ID NO:17)  (3744)  AAGTCCTGG AAAGAAGGGTCACATT TAACCCATACAGT
FAD3C'' (SEQ ID NO:19)  (3649)  AAGTCCTGG AAAGAAGGGTCACATT TAACCCATACAGT
FAD3C   (SEQ ID NO:18)  (2797)  AAGTCCTGGTAAAGAAGGGTCACATTATAACCCATACAGT 4121                                    4160
FAD3A   (SEQ ID NO:15)  (2267)   GTTTATTTGCCCCAAGCGAGAG AAGCTTATTGCAACTT
FAD3A'  (SEQ ID NO:16)  (2992)  GGTTTATTTGC CCAAGCGAGAG AAGCTTATTGCAACTT
FAD3C'  (SEQ ID NO:20)  (3666)  GGTTTATTTGC CCAAGCGAGAG AAGCTTATTGCAACTT
FAD3A'' (SEQ ID NO:17)  (3784)   GTTTATTTGC CCAAGCGAGAGGAAGCTTATTGCAACTT
FAD3C'' (SEQ ID NO:19)  (3689)   GTTTATTTGC CCAAGCGAGAGGAAGCTTATTGCAACTT
FAD3C   (SEQ ID NO:18)  (2837)   GTTTATTTGCCCCAAGCGAGAG AAGCTTATTGCAACTT
```

FIG. 3Z

```
                                     4161                                    4200
FAD3A   (SEQ ID NO:15) (2307) CAACAACTTGCTGGTCGATCATGTTGGCCAGTCTTGTTT
FAD3A'  (SEQ ID NO:16) (3032) CGACAACTTGCTGGTCAATAGTGTTGGCAATTCTTATCTG
FAD3C'  (SEQ ID NO:20) (3706) CAACAACTTGCTGGTCAATAGTGTTGGCAATTCTTATCTG
FAD3A'' (SEQ ID NO:17) (3824) CAACAACTTGCTGGTCAATAGTGTTGGCAGTCTTGTTT
FAD3C'' (SEQ ID NO:19) (3729) CAACAACTTGCTGGTCAATAGTGTTGGCAGTCTTGTTT
FAD3C   (SEQ ID NO:18) (2877) CAACAACTTGCTGGTCGATCGTGTTGGCAGTCTTGTTT 4201                                    4240
FAD3A   (SEQ ID NO:15) (2347) TCTATCATTCCTCGTTGATCCAGTCACAGTTCTAAAAGT
FAD3A'  (SEQ ID NO:16) (3072) TCTTTCCTTCCTCGTTGATCCAGTCACAGTTCTAAAAGTA
FAD3C'  (SEQ ID NO:20) (3746) TCTTTCCTTCCTCGTTGATCCAGTCACAGTTCTAAAAGTA
FAD3A'' (SEQ ID NO:17) (3864) TCTATCGTTCCTCGTTGATCCAGTCACAGTTCTAAAAGT
FAD3C'' (SEQ ID NO:19) (3769) TCTATCGTTCCTCGTTGATCCAGTCACAGTTCTAAAAGT
FAD3C   (SEQ ID NO:18) (2917) TCTATCATTCCTCGTTGATCCAGTCACAGTTCTAAAAGT 4241                                    4280
FAD3A   (SEQ ID NO:15) (2387) TAGGAGTTCCTTACATAGTAAGTTTCAAA-TATA---
FAD3A'  (SEQ ID NO:16) (3112) TACGGAGTTCCTTACATAGTAAGTTCTAGTATAAATA
FAD3C'  (SEQ ID NO:20) (3786) TACGGAGTTCCTTACATCGTAAGTTCTAGTATAAATA
FAD3A'' (SEQ ID NO:17) (3904) TAGGAGTTCCTTACATAGTAAGTTTCCA-TATAATTAC
FAD3C'' (SEQ ID NO:19) (3809) TAGGCGTTCCTTACATAGTAAGTTTCACA-TATAATTAC
FAD3C   (SEQ ID NO:18) (2957) TAGGAGTTCCTTACATAGTAAGTTTCAAA-TATA---

4281                                    4320
FAD3A   (SEQ ID NO:15) (2423) ------ATTATTTATCATTGCAATATA---------AT
FAD3A'  (SEQ ID NO:16) (3152) AAGTATAAATTTATTATTCAATATAATACTATATGAT
FAD3C'  (SEQ ID NO:20) (3826) AAGTATAAATTTATTATTCAATATAATACTATATGAT
FAD3A'' (SEQ ID NO:17) (3943) AAA-ATTTATATATATTAAAATAAA---------TT
FAD3C'' (SEQ ID NO:19) (3848) AAA-ATTTATATATATTAAAATAAA---------TT
FAD3C   (SEQ ID NO:18) (2993) ------TTATTTATCATTGCAATATA---------AT
```

FIG. 3A'

```
                                   4321                                    4360
FAD3A   (SEQ ID NO:15) (2448)  TTTTTTTGACATAAA-ATTTGAAAAAATCAGATCTT
FAD3A'  (SEQ ID NO:16) (3192)  TTTTTTTGTCATATA-TTTTG--AAAAATCAGATCTT
FAD3C'  (SEQ ID NO:20) (3866)  TTTTTTTGTCATAAA-CTTTG--AAA---TCAGATCTT
FAD3A'' (SEQ ID NO:17) (3973)  TGTTTTTGACATAAA-ATTTGAAAAATCAGATCTT
FAD3C'' (SEQ ID NO:19) (3878)  TGTTTTTGACATAAG-GTTTGAAAAATCAGATCTT
FAD3C   (SEQ ID NO:18) (3018)  TTTTTTTGACATAAAATTTGAAAAATCAGATCTT 4361                                    4400
FAD3A   (SEQ ID NO:15) (2487)  TGTAATGTGGTTGGACGCTGTCACTTACTTGCATCACCAT
FAD3A'  (SEQ ID NO:16) (3229)  TGTAATGTGGTTGGACGCTGTCACTTACTTGCATCACCAT
FAD3C'  (SEQ ID NO:20) (3901)  TGTAATGTGGTTGGACGCTGTCACTTACTTGCATCACCAT
FAD3A'' (SEQ ID NO:17) (4012)  TGTAATGTGGTTGGACGCTGTCACTTACTTGCATCACCAT
FAD3C'' (SEQ ID NO:19) (3917)  TGTAATGTGGTTGGACGCTGTCACTTACTTGCATCACCAT
FAD3C   (SEQ ID NO:18) (3058)  TGTAATGTGGTTGGACGCTGTCACTTACTTGCATCACCAT 4401                                    4440
FAD3A   (SEQ ID NO:15) (2527)  GGTCAGGATGATAAGCTGCCTTGGTACAGAGGCAAGGTAA
FAD3A'  (SEQ ID NO:16) (3269)  GGTCATGATGAGAAGCTGCCTTGGTACAGAGGCAAGGTAA
FAD3C'  (SEQ ID NO:20) (3941)  GGTCATGATGAGAAGCTGCCTTGGTACAGAGGCAAGGTAA
FAD3A'' (SEQ ID NO:17) (4052)  GGTCAGGATGAGAAGCTGCCTTGGTACAGAGGCAAGGTAA
FAD3C'' (SEQ ID NO:19) (3957)  GGTCAGGATGAGAAGCTGCCTTGGTACAGAGGCAAGGTAA
FAD3C   (SEQ ID NO:18) (3098)  GGTCAGGATGATAAGCTGCCTTGGTACAGAGGCAAGGTAA 4441                                    4480
FAD3A   (SEQ ID NO:15) (2567)  GTAGATCAACAT--------AATTTATAA---------G
FAD3A'  (SEQ ID NO:16) (3309)  TTAAATTAACTATTACAA--GTATTTAC----------A
FAD3C'  (SEQ ID NO:20) (3981)  TTAAATTAACCCTAGGT--GATTTTCACTGCTCATGTA
FAD3A'' (SEQ ID NO:17) (4092)  ATAAATTAATTTTAAAGAATGTTA---------A
FAD3C'' (SEQ ID NO:19) (3997)  TTAATTAATTTTAAAGAATGTTA-----------A
FAD3C   (SEQ ID NO:18) (3138)  GTAGATAAAA--------A-TTTTTA---------G
```

FIG. 3B'

```
                                           4481                                      4520
FAD3A   (SEQ ID NO:15)  (2590)  AACAACAAGGATTAGTAT-TTGATTAATCA-AATTATT
FAD3A'  (SEQ ID NO:16)  (3337)  AAACTAAGGATTAGTATATTGATTAATCGTAATTCTT
FAD3C'  (SEQ ID NO:20)  (4019)  CGGATTAAATATTTCTAAGTAAATTAGATAATAATT
FAD3A'' (SEQ ID NO:17)  (4123)  AACAATAATGTTAGTA--TTGATTAATCG-AATTTT
FAD3C'' (SEQ ID NO:19)  (4028)  AACAATAATGTTAGTA--TTGATTAATCG-AATTTT
FAD3C   (SEQ ID NO:18)  (3160)  AACAATAAGGATTAGTAG-TTGATAATCG-AATTTT 4521                                      4560
FAD3A   (SEQ ID NO:15)  (2628)  GATGTTTGTGTACAATAATAGAAGGAGTTATTACGT
FAD3A'  (SEQ ID NO:16)  (3377)  GATGTTTGTGATTATAATAGAAGGAGTTACTACGT
FAD3C'  (SEQ ID NO:20)  (4059)  AATGTTATGTATTTTAATTTAAATTAGTTTATAATTT
FAD3A'' (SEQ ID NO:17)  (4160)  GATGTTTGCAACAATAATAGAAGGAGTTATTACGT
FAD3C'' (SEQ ID NO:19)  (4065)  GATGTTTGCAACAATAATAGAAGGAGTTATTACGT
FAD3C   (SEQ ID NO:18)  (3198)  GATGTTT-GTGACAATAATAGAAGGAGTTATTACGT 4561                                      4600
FAD3A   (SEQ ID NO:15)  (2668)  GGAGGATTAACAACTATTGATAGAG-----ATTACGG-GA
FAD3A'  (SEQ ID NO:16)  (3417)  GGAGGATTAACAACTATTGATAGAG-----ATTACGG-AA
FAD3C'  (SEQ ID NO:20)  (4099)  GTATGCATGATTTATGTTAATAAAATTTATATTACTTTAA
FAD3A'' (SEQ ID NO:17)  (4200)  GGAGGATTAACAACTATTGATAGAG-----ATTACGG-AA
FAD3C'' (SEQ ID NO:19)  (4105)  GGAGGATTAACAACTATTGATAGAG-----ATTACGG-AA
FAD3C   (SEQ ID NO:18)  (3237)  GGAGGATTAACAACTGTTGATAGAG-----ATTACGG-GA 4601                                      4640
FAD3A   (SEQ ID NO:15)  (2702)  TCTTCAACAACATTCATCACGACATTGAACTCACGTGAT
FAD3A'  (SEQ ID NO:16)  (3451)  TTTTCAACAACATTCATCACGACATTGAACTCACGTGAT
FAD3C'  (SEQ ID NO:20)  (4139)  TTATAAATATGATTT-TATATAGGTTATATCTAATCGGTT
FAD3A'' (SEQ ID NO:17)  (4234)  TCTTCAACAACATCCATCACGACATTGAACTCACGTGAT
FAD3C'' (SEQ ID NO:19)  (4139)  TCTTCAACAACATCCATCACGACATTGAACTCACGTGAT
FAD3C   (SEQ ID NO:18)  (3271)  TCTTCAACAACATTCATCACGACATTGAACTCACGTGAT
```

FIG. 3C'

```
                                    4641                                    4680
FAD3A   (SEQ ID NO:15)  (2742)  CCATCATCTTTCCCACAAATCCTCACTATCACTTGGT
FAD3A'  (SEQ ID NO:16)  (3491)  CATCATCTTTCCCACAATCCTCATATCACTTGCC
FAD3C'  (SEQ ID NO:20)  (4178)  TTGTTGTTTTACAGTCGATTTAGT----TATCATTTGGGT
FAD3A'' (SEQ ID NO:17)  (4274)  CATCATCTTTCCCACAAATCCTCACTATCACTTGG
FAD3C'' (SEQ ID NO:19)  (4179)  CATCATCTTTCCCACAAATCCTCACTATCACTTGG
FAD3C   (SEQ ID NO:18)  (3311)  CATCATCTTTCCCACAAATCCTCACTATCACTTGG 4681                                    4720
FAD3A   (SEQ ID NO:15)  (2782)  CATCCGTGAGCATCTCCT-----CCT----TAGTT
FAD3A'  (SEQ ID NO:16)  (3531)  CATCGTGCAGCATCTACTCCGGCTAC------TTT
FAD3C'  (SEQ ID NO:20)  (4215)  -AAATTGGATTGCATCTAGAATCAACTGAATATTTT
FAD3A'' (SEQ ID NO:17)  (4314)  CATCGGTCAGCATCTACCTCCTCCTCC---TAGTT
FAD3C'' (SEQ ID NO:19)  (4219)  CATCCGTGAGCATCTACCTCTCCTCC---TAGTT
FAD3C   (SEQ ID NO:18)  (3351)  CATCCGTGAGCATCTCCC----CCTCC---TAGTT 4721                                    4760
FAD3A   (SEQ ID NO:15)  (2815)  CATCGATTAAGA--CAAACCTGATTAATTACTAAA
FAD3A'  (SEQ ID NO:16)  (3565)  CATCAAAACCACTTGACAAACCTGATTAATTACTAAG
FAD3C'  (SEQ ID NO:20)  (4254)  CATCCAACCACT--CAAATTTTGATTAATTTCTTAA
FAD3A'' (SEQ ID NO:17)  (4351)  CATCGATTAAA--------TGCTGATTAATTACTAA
FAD3C'' (SEQ ID NO:19)  (4256)  CATCGATTAAA--------TGCTGATTAATTACTAA
FAD3C   (SEQ ID NO:18)  (3384)  CATCGATTAA----CAAACCTGATTAATTACTAAA 4761                                    4800
FAD3A   (SEQ ID NO:15)  (2853)  TAGTGATCTTAATTAATGATACG-ACAGACGAAATCA
FAD3A'  (SEQ ID NO:16)  (3605)  TAGTGATTTT-ACAAATGGAATGTCACAGACAAAACAG
FAD3C'  (SEQ ID NO:20)  (4292)  T--CCATT-----AGGTGGCCTGTCTTAGAACTT----
FAD3A'' (SEQ ID NO:17)  (4383)  TA--------C-TTAACGAACCTGCACGAGCCA
FAD3C'' (SEQ ID NO:19)  (4288)  TA--------C-TTAATGAACCTGCACGAGCCA
FAD3C   (SEQ ID NO:18)  (3421)  TAGTCATCTTAATTAATGCACC-ACAGACGAACCA
```

FIG. 3D'

```
                                          4801                                    4840
FAD3A   (SEQ ID NO:15)  (2892)  CTAAACATGTGTTCGAAGATACTACAGAGAACCAAGAG
FAD3A'  (SEQ ID NO:16)  (3644)  CTAAACATGTGTTCGAAGATACTACAGAGAACCAAAGAG
FAD3C'  (SEQ ID NO:20)  (4322)  -TAAATATATTTTATAAGATTATGTATAACTTATTATAT
FAD3A'' (SEQ ID NO:17)  (4414)  CTAAACATGTGTTACGAAGATACTACAGAGTGCGAAGAG
FAD3C'' (SEQ ID NO:19)  (4319)  CTAAACATGTGTTACGAAGATACTACAGAGTGCGAAGAG
FAD3C   (SEQ ID NO:18)  (3460)  CTAAACATGTGTTCGAAGATACTACAGAGAACCAAGAG 4841                                    4880
FAD3A   (SEQ ID NO:15)  (2932)  GTCAGGAGC----AAT--ACCGATCACTTGTGAAGT
FAD3A'  (SEQ ID NO:16)  (3684)  GTCAGGAGC----AAT--ACCGATCACTTGTGAGAGT
FAD3C'  (SEQ ID NO:20)  (4361)  ATATTGTGCTTAAAATGAAATAAAAATAAAATAAATGT
FAD3A'' (SEQ ID NO:17)  (4454)  GTCAGGAGC----AAT--ACCGATTACTTGTCAGAGT
FAD3C'' (SEQ ID NO:19)  (4359)  GTCAGGAGC----AAT--ACCGATTACTTGTCAGAGT
FAD3C   (SEQ ID NO:18)  (3500)  GTCAGGAGC----AAT--ACCGATCACTTAGTGAAAGT 4881                                    4920
FAD3A   (SEQ ID NO:15)  (2966)  GTGTGCAAGTATTAAAAAGATTACGTCAGTGACT
FAD3A'  (SEQ ID NO:16)  (3718)  GTGTACAAGTATTAAAAAGATTACGTCAGTGACT
FAD3C'  (SEQ ID NO:20)  (4401)  CTGATTCTAAATTACATAAATTAATATAACGATAAT-ATT
FAD3A'' (SEQ ID NO:17)  (4488)  GTGTCCAAGTATTAAAAAGATTACGTCAGTGACT
FAD3C'' (SEQ ID NO:19)  (4393)  GTGTCCAAGTATTAAAAAGATTACGTCAGTGACT
FAD3C   (SEQ ID NO:18)  (3534)  GTGTGCAAGTATTAAAAAGATTACGTCAGTGACT 4921                                    4960
FAD3A   (SEQ ID NO:15)  (3006)  CTG---GTCATATTGTCTTCTACC---AGACAGATCGAGAT
FAD3A'  (SEQ ID NO:16)  (3758)  CTG---GTCACATTGTCTTCTACC---AGACTGATCGAGAT
FAD3C'  (SEQ ID NO:20)  (4440)  CTGAAGTCTCATGCATATATATATAAATTTTACAAAAG
FAD3A'' (SEQ ID NO:17)  (4528)  CTG--GTCATATTGTCTTCTACC---AGACAGATCGAGAT
FAD3C'' (SEQ ID NO:19)  (4433)  CTG--GTCATATTGTCTTCTACC---AGACAGATCGAGAT
FAD3C   (SEQ ID NO:18)  (3574)  CTG--GTCATATTGTCTTCTACC---AGACAGATCGAGAT
```

FIG. 3E'

|                          |         | 4961                                     | 5000 |
|--------------------------|---------|------------------------------------------|------|
| FAD3A   (SEQ ID NO:15)   | (3041)  | CTCTACGTT-TATCCTTTGACAA-ATCAAAACAACTA    |      |
| FAD3A'  (SEQ ID NO:16)   | (3793)  | CTCTACGTT-TATCCTTTGTAA-ATGAAAACAATA      |      |
| FAD3C'  (SEQ ID NO:20)   | (4480)  | AACTAAATTGTAACATTTGGTTAATATTTTACAGTAATA  |      |
| FAD3A'' (SEQ ID NO:17)   | (4563)  | CTCTACGTT-TATCCTTGGACAA-ATCAAAACAATA     |      |
| FAD3C'' (SEQ ID NO:19)   | (4468)  | CTCTACGTT-TATCCTTGACAA-ATCAAAACAATA      |      |
| FAD3C   (SEQ ID NO:18)   | (3609)  | CTCTACGTT-TATCCTTGACAA-ATCAAAACAATA      |      |

|                          |         | 5001                                     | 5040 |
|--------------------------|---------|------------------------------------------|------|
| FAD3A   (SEQ ID NO:15)   | (3079)  | ACTTCTTCCACTGTATTA----------GAATA        |      |
| FAD3A'  (SEQ ID NO:16)   | (3831)  | AATTCTTCCCCTTTTGTTAGCACTATTATGAATA       |      |
| FAD3C'  (SEQ ID NO:20)   | (4520)  | AAATATTTATAAATTTAAA----ACT-TTATGTATTT    |      |
| FAD3A'' (SEQ ID NO:17)   | (4601)  | ACTTCTTCCACTGTATT-A----------GAATA       |      |
| FAD3C'' (SEQ ID NO:19)   | (4506)  | ACTTCTTCCACTGTATT-A----------GAATA       |      |
| FAD3C   (SEQ ID NO:18)   | (3647)  | ATTTCTTCCACTGTATTA----------GAATA        |      |

|                          |         | 5041                                     | 5080 |
|--------------------------|---------|------------------------------------------|------|
| FAD3A   (SEQ ID NO:15)   | (3109)  | AACGCTTGGTCTACTAATCTGGTCCTTAA            |      |
| FAD3A'  (SEQ ID NO:16)   | (3871)  | A--CAGTTTCTT---ACTAATATGTCCTTAA          |      |
| FAD3C'  (SEQ ID NO:20)   | (4556)  | A--TTTATTGAATGGAAACTGAAATTTACTTAAATAAT   |      |
| FAD3A'' (SEQ ID NO:17)   | (4630)  | A-ACTCCTTCCCTT-ACTATTGTCCTCCTT-A         |      |
| FAD3C'' (SEQ ID NO:19)   | (4535)  | A-ACTCCTTCCCTT-ACTATTGTCCTCCTT-A         |      |
| FAD3C   (SEQ ID NO:18)   | (3677)  | AAACTCCTTGGTC-ACTAATCTGGTCCTTAA          |      |

|                          |         | 5081                                     | 5120 |
|--------------------------|---------|------------------------------------------|------|
| FAD3A   (SEQ ID NO:15)   | (3149)  | CTTAAA--TGACTCGTGAAACTTTTTA-ATAAATGT     |      |
| FAD3A'  (SEQ ID NO:16)   | (3906)  | CTTAAAATGTACTCGTGAAACCTTCTTACTTAGATAT    |      |
| FAD3C'  (SEQ ID NO:20)   | (4594)  | CTTAAAATGAAACATATTGCTTGGTATTTTGCTTAT     |      |
| FAD3A'' (SEQ ID NO:17)   | (4667)  | CTTAATGACTCGTGAACCTTT----ATTATTGT        |      |
| FAD3C'' (SEQ ID NO:19)   | (4572)  | CTTAAATGACTCGTGAACCTTTT-ATTATTGT         |      |
| FAD3C   (SEQ ID NO:18)   | (3716)  | CTTAAATGACTCGTGAACTTTT-ATTATTGT          |      |

FIG. 3F'

```
                              5121                                    5160
FAD3A   (SEQ ID NO:15)  (3186) ATTTACATT------ACAAATC----AAGTTTTGTTCG
FAD3A'  (SEQ ID NO:16)  (3946) TATTCCATT------TACA--CTAAAACATACAATTTC
FAD3C'  (SEQ ID NO:20)  (4634) GGTTCCATTAAGTTCTACAACTAAAACATAACATTTA
FAD3A'' (SEQ ID NO:17)  (4704) ATTTACGTT------ACAAAAGTGGAAGTTT-GTTAT
FAD3C'' (SEQ ID NO:19)  (4611) ATTTACGTT------ACAAAAGTGGAAGTTT-GTTAT
FAD3C   (SEQ ID NO:18)  (3755) ATTTACATT------ACAAATCGTAAAAGTTTTTGTTCG 5161                                    5200
FAD3A   (SEQ ID NO:15)  (3215) TTTCTTTACTTTACTACAA---TA----ATTAAG-
FAD3A'  (SEQ ID NO:16)  (3978) AAAGGT-TGAAAAGAAAACAAAATTACT---AGAATA
FAD3C'  (SEQ ID NO:20)  (4674) AAAAGTGTGATAACTTAAATATTGATCAAACAATA
FAD3A'' (SEQ ID NO:17)  (4736) CAATTTCAGTTGCAACAAAAGG--------------
FAD3C'' (SEQ ID NO:19)  (4643) CAATTTCAGTTGCAACAAAAGG--------------
FAD3C   (SEQ ID NO:18)  (3788) TTTCTGTACTTTTACTTAAAACTAC--ATCAAA 5201                                    5240
FAD3A   (SEQ ID NO:15)  (3248) ---------------------------------------
FAD3A'  (SEQ ID NO:16)  (4014) C--------------------------------------
FAD3C'  (SEQ ID NO:20)  (4714) TTATTTTTAATTTTAATTTTAGTTTTTTAATAACTCTTA
FAD3A'' (SEQ ID NO:17)  (4762) ---------------------------------------
FAD3C'' (SEQ ID NO:19)  (4669) ---------------------------------------
FAD3C   (SEQ ID NO:18)  (3826) AG-------------------------------------

5241                                    5280
FAD3A   (SEQ ID NO:15)  (3248) ---------------------------------------
FAD3A'  (SEQ ID NO:16)  (4015) ---------------------------------------
FAD3C'  (SEQ ID NO:20)  (4754) AAAATAAGCAGTGAACAAAAGTGAGATTGTATTTGAAATT
FAD3A'' (SEQ ID NO:17)  (4762) ---------------------------------------
FAD3C'' (SEQ ID NO:19)  (4669) ---------------------------------------
FAD3C   (SEQ ID NO:18)  (3828) ---------------------------------------
```

FIG. 3G'

```
                                      5281                                    5320
FAD3A   (SEQ ID NO:15)  (3248)  ----------------------------------------
FAD3A'  (SEQ ID NO:16)  (4015)  ----------------------------------------
FAD3C'  (SEQ ID NO:20)  (4794)  AATATTATACAAGTAAAATATAATTTTTTAAGTTTATAAA
FAD3A'' (SEQ ID NO:17)  (4762)  ----------------------------------------
FAD3C'' (SEQ ID NO:19)  (4669)  ----------------------------------------
FAD3C   (SEQ ID NO:18)  (3828)  ----------------------------------------

5321                                    5360
FAD3A   (SEQ ID NO:15)  (3248)  ----------------------------------------
FAD3A'  (SEQ ID NO:16)  (4015)  ----------------------------------------
FAD3C'  (SEQ ID NO:20)  (4834)  AAAATTCCTTTTTATTATATGTATATGTTTTTTTGGAAAA
FAD3A'' (SEQ ID NO:17)  (4762)  ----------------------------------------
FAD3C'' (SEQ ID NO:19)  (4669)  ----------------------------------------
FAD3C   (SEQ ID NO:18)  (3828)  ----------------------------------------

5361                                    5400
FAD3A   (SEQ ID NO:15)  (3248)  ----------------------------------------
FAD3A'  (SEQ ID NO:16)  (4015)  ----------------------------------------
FAD3C'  (SEQ ID NO:20)  (4874)  TTTTAAAAGGAAACTAAATAAAAAAATAAATAATAGTAT
FAD3A'' (SEQ ID NO:17)  (4762)  ----------------------------------------
FAD3C'' (SEQ ID NO:19)  (4669)  ----------------------------------------
FAD3C   (SEQ ID NO:18)  (3828)  ----------------------------------------

5401                                    5440
FAD3A   (SEQ ID NO:15)  (3248)  ----------------------------------------
FAD3A'  (SEQ ID NO:16)  (4015)  ----------------------------------------
FAD3C'  (SEQ ID NO:20)  (4914)  TTTAAATGTAATATTTTTAATTCATTAAGTGTATTAGTGT
FAD3A'' (SEQ ID NO:17)  (4762)  ----------------------------------------
FAD3C'' (SEQ ID NO:19)  (4669)  ----------------------------------------
FAD3C   (SEQ ID NO:18)  (3828)  ----------------------------------------
```

FIG. 3H'

```
                                       5441                                    5480
FAD3A   (SEQ ID NO:15)  (3248)  ----------------------------------------
FAD3A'  (SEQ ID NO:16)  (4015)  ----------------------------------------
FAD3C'  (SEQ ID NO:20)  (4954)  AATCAACTATCGTGAGAGTTAACGTGAGAGCGATACATAG
FAD3A'' (SEQ ID NO:17)  (4762)  ----------------------------------------
FAD3C'' (SEQ ID NO:19)  (4669)  ----------------------------------------
FAD3C   (SEQ ID NO:18)  (3828)  ----------------------------------------

5481                                    5520
FAD3A   (SEQ ID NO:15)  (3248)  ----------------------------------------
FAD3A'  (SEQ ID NO:16)  (4015)  ----------------------------------------
FAD3C'  (SEQ ID NO:20)  (4994)  AAAACCGACTTCTCAAATAATATTTTATAGAGATTACGAT
FAD3A'' (SEQ ID NO:17)  (4762)  ----------------------------------------
FAD3C'' (SEQ ID NO:19)  (4669)  ----------------------------------------
FAD3C   (SEQ ID NO:18)  (3828)  ----------------------------------------

5521                                    5560
FAD3A   (SEQ ID NO:15)  (3248)  ----------------------------------------
FAD3A'  (SEQ ID NO:16)  (4015)  ----------------------------------------
FAD3C'  (SEQ ID NO:20)  (5034)  GTTTCACAAAAAAAATTATTAGTATTTGATTAATCTTAA
FAD3A'' (SEQ ID NO:17)  (4762)  ----------------------------------------
FAD3C'' (SEQ ID NO:19)  (4669)  ----------------------------------------
FAD3C   (SEQ ID NO:18)  (3828)  ----------------------------------------

5561                                    5600
FAD3A   (SEQ ID NO:15)  (3248)  ----------------------------------------
FAD3A'  (SEQ ID NO:16)  (4015)  ----------------------------------------
FAD3C'  (SEQ ID NO:20)  (5074)  TTCTTGATGTTTTGTGATTAATAATAGGAATGGAGTTACT
FAD3A'' (SEQ ID NO:17)  (4762)  ----------------------------------------
FAD3C'' (SEQ ID NO:19)  (4669)  ----------------------------------------
FAD3C   (SEQ ID NO:18)  (3828)  ----------------------------------------
```

FIG. 3I'

```
                                   5601                                 5640
FAD3A   (SEQ ID NO:15)  (3248) ----------------------------------------
FAD3A'  (SEQ ID NO:16)  (4015) ----------------------------------------
FAD3C'  (SEQ ID NO:20)  (5114) TACGTGGAGGATTAACAACTATTGATAGAGATTACGGAAT
FAD3A'' (SEQ ID NO:17)  (4762) ----------------------------------------
FAD3C'' (SEQ ID NO:19)  (4669) ----------------------------------------
FAD3C   (SEQ ID NO:18)  (3828) ----------------------------------------

5641                                 5680
FAD3A   (SEQ ID NO:15)  (3248) ----------------------------------------
FAD3A'  (SEQ ID NO:16)  (4015) ----------------------------------------
FAD3C'  (SEQ ID NO:20)  (5154) TTTCAACAACATTCATCACGACATTGGAACTCACGTGATC
FAD3A'' (SEQ ID NO:17)  (4762) ----------------------------------------
FAD3C'' (SEQ ID NO:19)  (4669) ----------------------------------------
FAD3C   (SEQ ID NO:18)  (3828) ----------------------------------------

5681                                 5720
FAD3A   (SEQ ID NO:15)  (3248) ----------------------------------------
FAD3A'  (SEQ ID NO:16)  (4015) ----------------------------------------
FAD3C'  (SEQ ID NO:20)  (5194) CATCATCTTTTCCCACAAATCCCTCACTATCACTTGGTCG
FAD3A'' (SEQ ID NO:17)  (4762) ----------------------------------------
FAD3C'' (SEQ ID NO:19)  (4669) ----------------------------------------
FAD3C   (SEQ ID NO:18)  (3828) ----------------------------------------

5721                                 5760
FAD3A   (SEQ ID NO:15)  (3248) ----------------------------------------
FAD3A'  (SEQ ID NO:16)  (4015) ----------------------------------------
FAD3C'  (SEQ ID NO:20)  (5234) ATGCTGTGAGTCATCTCACTCTCTCGCTACTTTCATCTAA
FAD3A'' (SEQ ID NO:17)  (4762) ----------------------------------------
FAD3C'' (SEQ ID NO:19)  (4669) ----------------------------------------
FAD3C   (SEQ ID NO:18)  (3828) ----------------------------------------
```

FIG. 3J'

```
                                                 5761                                    5800
    FAD3A   (SEQ ID NO:15)   (3248)  ----------------------------------------
    FAD3A'  (SEQ ID NO:16)   (4015)  ----------------------------------------
    FAD3C'  (SEQ ID NO:20)   (5274)  ACCATTTCATTAAAGGGTGATTAATTACTAATGTACTGAT
    FAD3A'' (SEQ ID NO:17)   (4762)  ----------------------------------------
    FAD3C'' (SEQ ID NO:19)   (4669)  ----------------------------------------
    FAD3C   (SEQ ID NO:18)   (3828)  ----------------------------------------

5801                                    5840
    FAD3A   (SEQ ID NO:15)   (3248)  ----------------------------------------
    FAD3A'  (SEQ ID NO:16)   (4015)  ----------------------------------------
    FAD3C'  (SEQ ID NO:20)   (5314)  TTTAACAAATGGAATGTGACAGACAAAAGCAGCTAAACAT
    FAD3A'' (SEQ ID NO:17)   (4762)  ----------------------------------------
    FAD3C'' (SEQ ID NO:19)   (4669)  ----------------------------------------
    FAD3C   (SEQ ID NO:18)   (3828)  ----------------------------------------

5841                                    5880
    FAD3A   (SEQ ID NO:15)   (3248)  ----------------------------------------
    FAD3A'  (SEQ ID NO:16)   (4015)  ----------------------------------------
    FAD3C'  (SEQ ID NO:20)   (5354)  GCGTTGGGAAGATACTACAGAGAACCGAAGACGTCAGGAG
    FAD3A'' (SEQ ID NO:17)   (4762)  ----------------------------------------
    FAD3C'' (SEQ ID NO:19)   (4669)  ----------------------------------------
    FAD3C   (SEQ ID NO:18)   (3828)  ----------------------------------------

5881                                    5920
    FAD3A   (SEQ ID NO:15)   (3248)  ----------------------------------------
    FAD3A'  (SEQ ID NO:16)   (4015)  ----------------------------------------
    FAD3C'  (SEQ ID NO:20)   (5394)  CAATACCGATCCACTTGGTGGAGAGTTTGGTAGCAAGTAT
    FAD3A'' (SEQ ID NO:17)   (4762)  ----------------------------------------
    FAD3C'' (SEQ ID NO:19)   (4669)  ----------------------------------------
    FAD3C   (SEQ ID NO:18)   (3828)  ----------------------------------------
```

FIG. 3K'

```
                                  5921                                    5960
FAD3A   (SEQ ID NO:15)  (3248)  ----------------------------------------
FAD3A'  (SEQ ID NO:16)  (4015)  ----------------------------------------
FAD3C'  (SEQ ID NO:20)  (5434)  TAAGAAAGATCATTACGTCAGTGACACCGGTGACATTGTC
FAD3A'' (SEQ ID NO:17)  (4762)  ----------------------------------------
FAD3C'' (SEQ ID NO:19)  (4669)  ----------------------------------------
FAD3C   (SEQ ID NO:18)  (3828)  ----------------------------------------

5961                                    6000
FAD3A   (SEQ ID NO:15)  (3248)  ----------------------------------------
FAD3A'  (SEQ ID NO:16)  (4015)  ----------------------------------------
FAD3C'  (SEQ ID NO:20)  (5474)  TTCTACGAGACTGATCCAGATCTCTACGTTTATGCTTCTG
FAD3A'' (SEQ ID NO:17)  (4762)  ----------------------------------------
FAD3C'' (SEQ ID NO:19)  (4669)  ----------------------------------------
FAD3C   (SEQ ID NO:18)  (3828)  ----------------------------------------

6001                                    6040
FAD3A   (SEQ ID NO:15)  (3248)  ----------------------------------------
FAD3A'  (SEQ ID NO:16)  (4015)  ----------------------------------------
FAD3C'  (SEQ ID NO:20)  (5514)  TCAAATCGAAAATCAATTAAACTTTCTTCCCCCTTTTTGT
FAD3A'' (SEQ ID NO:17)  (4762)  ----------------------------------------
FAD3C'' (SEQ ID NO:19)  (4669)  ----------------------------------------
FAD3C   (SEQ ID NO:18)  (3828)  ----------------------------------------

6041                                    6080
FAD3A   (SEQ ID NO:15)  (3248)  ----------------------------------------
FAD3A'  (SEQ ID NO:16)  (4015)  ----------------------------------------
FAD3C'  (SEQ ID NO:20)  (5554)  TTAGCCCTATTATGAATAAACCAGTCTTTTTTCACTTATT
FAD3A'' (SEQ ID NO:17)  (4762)  ----------------------------------------
FAD3C'' (SEQ ID NO:19)  (4669)  ----------------------------------------
FAD3C   (SEQ ID NO:18)  (3828)  ----------------------------------------
```

FIG. 3L'

```
                                       6081                                      6120
FAD3A   (SEQ ID NO:15)  (3248)  ----------------------------------------
FAD3A'  (SEQ ID NO:16)  (4015)  ----------------------------------------
FAD3C'  (SEQ ID NO:20)  (5594)  TATTGGTGTTTTTAAGTTAAAAATGTACTCGTGAAACTCT
FAD3A'' (SEQ ID NO:17)  (4762)  ----------------------------------------
FAD3C'' (SEQ ID NO:19)  (4669)  ----------------------------------------
FAD3C   (SEQ ID NO:18)  (3828)  ----------------------------------------

6121                                      6160
FAD3A   (SEQ ID NO:15)  (3248)  ----------------------------------------
FAD3A'  (SEQ ID NO:16)  (4015)  ----------------------------------------
FAD3C'  (SEQ ID NO:20)  (5634)  TCTTTTATTATTAATCCATTTATACACTGAAAAACATACA
FAD3A'' (SEQ ID NO:17)  (4762)  ----------------------------------------
FAD3C'' (SEQ ID NO:19)  (4669)  ----------------------------------------
FAD3C   (SEQ ID NO:18)  (3828)  ----------------------------------------

6161                                      6200
FAD3A   (SEQ ID NO:15)  (3248)  ----------------------------------------
FAD3A'  (SEQ ID NO:16)  (4015)  ----------------------------------------
FAD3C'  (SEQ ID NO:20)  (5674)  ATTTCAAAGGTTAAAAAGAAAAATAAATTTTCTAGACTGA
FAD3A'' (SEQ ID NO:17)  (4762)  ----------------------------------------
FAD3C'' (SEQ ID NO:19)  (4669)  ----------------------------------------
FAD3C   (SEQ ID NO:18)  (3828)  ----------------------------------------

6201
FAD3A   (SEQ ID NO:15)  (3248)  -
FAD3A'  (SEQ ID NO:16)  (4015)  -
FAD3C'  (SEQ ID NO:20)  (5714)  C
FAD3A'' (SEQ ID NO:17)  (4762)  -
FAD3C'' (SEQ ID NO:19)  (4669)  -
FAD3C   (SEQ ID NO:18)  (3828)  -
```

FIG. 3M'

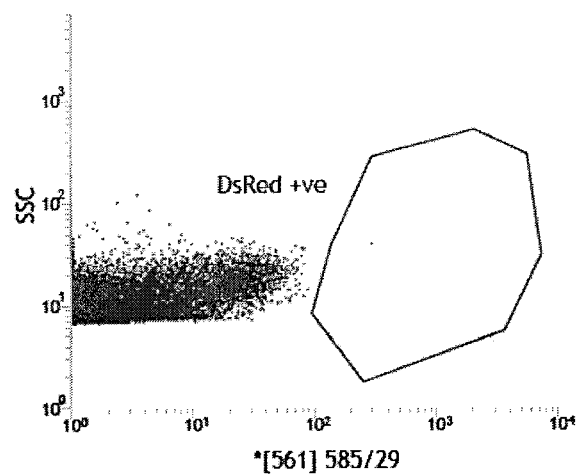
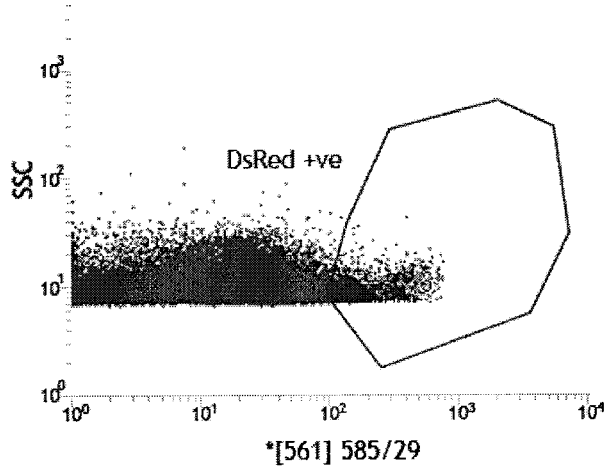
FIG. 20

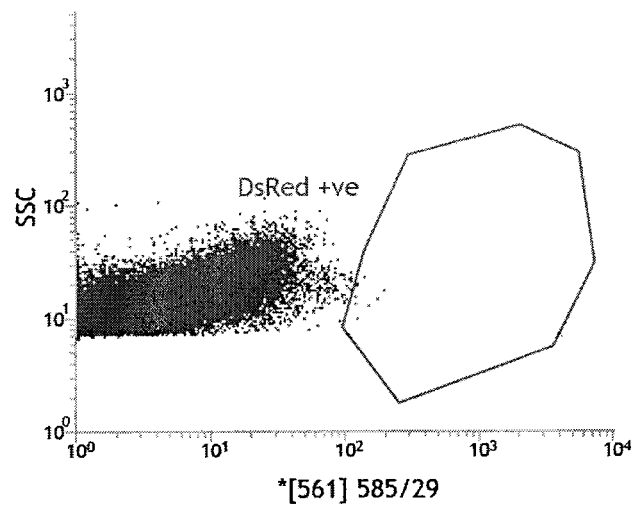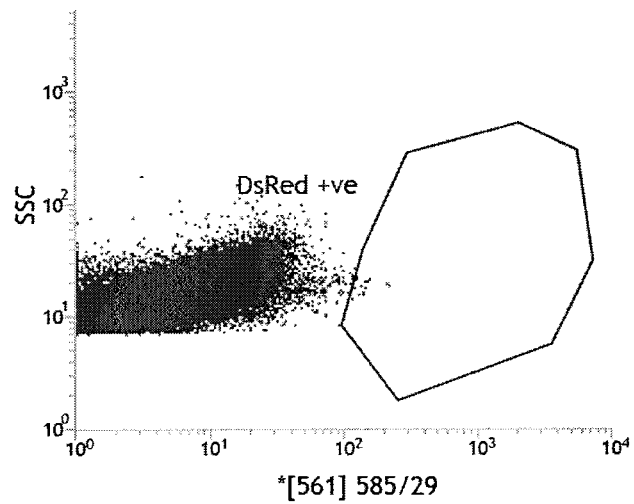
FIG. 22

FAD2A locus with perfect ETIP integration -hph qPCR primer binding sites

ENGINEERED TRANSGENE INTEGRATION PLATFORM (ETIP) FOR GENE TARGETING AND TRAIT STACKING

CROSS-REFERENCE TO RELATED APPLICATIONS

The present application claims priority to the benefit of U.S. Provisional Patent Application No. 61/697,882, filed Sep. 7, 2012, and the disclosure of which is hereby incorporated by reference in its entirety.

FIELD OF THE DISCLOSURE

The disclosure relates to the field of plant precision transformation, gene targeting, targeted genomic integration and protein expression in plants. In a preferred embodiment, the disclosure describes an Engineered Transgene Integration Platform (ETIP) that can be inserted randomly or at targeted locations in plant genomes.

BACKGROUND

To meet the challenge of increasing global demand for food production, the typical approaches to improving agricultural productivity (e.g. enhanced yield or engineered pest resistance) have relied on either mutation breeding or introduction of novel genes into the genomes of crop species by transformation. These processes are inherently nonspecific and relatively inefficient. For example, conventional plant transformation methods deliver exogenous DNA that integrates into the genome at random locations. Thus, in order to identify and isolate transgenic plant lines with desirable attributes, it is necessary to generate hundreds of unique random integration events per construct and subsequently screen for the desired individuals. As a result, conventional plant trait engineering is a laborious, time-consuming, and unpredictable undertaking. Furthermore, the random nature of these integrations makes it difficult to predict whether pleiotropic effects due to unintended genome disruption have occurred.

The random nature of the current transformation processes requires the generation of hundreds of events for the identification and selection of transgene event candidates (transformation and event screening is rate limiting relative to gene candidates identified from functional genomic studies). In addition, depending upon the location of integration within the genome, a gene expression cassette may be expressed at different levels as a result of the genomic position effect. This genomic position effect makes comparing the impact of different regulatory elements and transgene designs via random insertion into the genome using conventional transformation process highly variable. As a result, the generation, isolation and characterization of plant lines with engineered genes or traits has been an extremely labor and cost-intensive process with a low probability of success.

Precision gene modification overcomes the logistical challenges of conventional practices in plant systems and has been a long-standing goal of basic plant researchers and agricultural biotechnologists. However, with the exception of "gene targeting" via positive-negative drug selection in rice, or the use of pre-engineered restriction sites, targeted genome modification in all plant species, both model and crop, has until recently proven elusive. Terada et al. (2002) *Nat Biotechnol* 20(10): 1030; Terada et al. (2007) *Plant Physiol* 144(2):846; D'Halluin et al. (2008) *Plant Biotechnology J.* 6(1):93.

Recently, methods and compositions for targeted cleavage of genomic DNA have been described. Such targeted cleavage events can be used, for example, to induce targeted mutagenesis or targeted deletions of cellular DNA sequences, or facilitate targeted recombination at a predetermined chromosomal locus. See, e.g., United States Patent Publications 2003/0232410, 2005/0208489, 2005/0026157, 2005/0064474 and 2006/0188987, and International Publication WO 2007/014275, the disclosures of which are incorporated by reference in their entireties for all purposes.

U.S. Patent Publication No. 2008/0182332 discloses the use of non-canonical zinc finger nucleases (ZFNs) for targeted modification of plant genomes. U.S. patent application Ser. No. 12/284,888 describes ZFN-mediated targeted integration into a plant EPSPS locus. However, the need for finding compositions and methods for identification, selection and rapid advancement of stable, targeted integration into precise locations within a plant genome still remains.

SUMMARY OF THE DISCLOSURE

An embodiment of the subject disclosure relates to a method for producing a transgenic plant cell. In a further embodiment a plant cell having genomic DNA comprising a targetable nucleic acid molecule is provided. Further embodiments include the targetable nucleic acid molecule comprising: at least one site specific nuclease recognition site; a first fragment of a first marker gene; and, a second fragment of a second marker gene. In another embodiment the plant cell is transformed with a donor nucleic acid molecule and a site specific nuclease nucleic acid molecule. In a subsequent embodiment the genomic DNA of the plant cell is cleaved with the at least one site specific nuclease recognition site. An additional embodiment includes the integration of the donor nucleic acid molecule into the targetable nucleic acid molecule, wherein the integration within the targetable nucleic acid molecule comprises at least one functional marker gene, to produce the transgenic plant cell, the transgenic plant cell comprising the targetable nucleic acid molecule and integrated donor nucleic acid molecule comprising at least one functional marker gene.

In yet another embodiment, the subject disclosure relates to a *Brassica napus* chromosomal target site selected from the group consisting of nucleotides 1-579 of SEQ ID NO: 431 to nucleotide 166-732 of SEQ ID NO:432, nucleotides 1-550 of SEQ ID NO:433 to nucleotides 190-653 of SEQ ID NO:434, nucleotides 1-298 of SEQ ID NO:435 to 51-644 of SEQ ID NO:436, nucleotides 1-536 of SEQ ID NO:437 to nucleotides 146-545 of SEQ ID NO:438, nucleotides, nucleotides 1-431 of SEQ ID NO:439 to nucleotides 167-685 of SEQ ID NO:440, nucleotides 1-599 of SEQ ID NO:441 to nucleotides 116-521 of SEQ ID NO:442, nucleotides 1-298 of SEQ ID NO:443 to nucleotides 193-775 of SEQ ID NO:444, and nucleotides 1-651 of SEQ ID NO:445 to nucleotides 120-578 of SEQ ID NO:446.

In a subsequent embodiment, the subject disclosure relates to a method for producing a transgenic plant cell. Further embodiments include the targetable nucleic acid molecule comprising: at least one site specific nuclease recognition site; a first fragment of a first marker gene; and, a second fragment of a second non-coding polynucleotide sequence. In another embodiment the plant cell is transformed with a donor nucleic acid molecule and a site specific nuclease nucleic acid molecule. In a subsequent embodiment the genomic DNA of the plant cell is cleaved with the at least one site specific nuclease recognition site. An additional embodiment includes the integration of the donor nucleic acid molecule into the targetable nucleic acid molecule, wherein the integration within the targetable nucleic acid molecule comprises at least one functional marker gene, to produce the transgenic plant cell, the transgenic plant cell comprising the targetable nucleic acid molecule and integrated donor nucleic acid molecule comprising at least one functional marker gene.

The foregoing and other features will become more apparent from the following detailed description of several embodiments, which proceeds with reference to the accompanying figures.

BRIEF DESCRIPTION OF THE FIGURES

FIG. 1A-1E: Shows a sequence alignment of FAD2 gene sequences, generated using AlignX®.

FIG. 3A-3M': Shows a sequence alignment of FAD3 gene sequences, generated using AlignX®.

FIG. 7: (B) Specific sequence context (SEQ ID NOs:471-480) surrounding the ZFN target site, identifying FAD2A and C containing tri-nucleotide repeats of C, T and G, leading to the observed increase in single base deletions through sequencing of the FAD2A and C loci.

FIG. 20: Shows the FACS sorting of canola protoplasts and the calculated transfection efficiency of canola protoplasts that were transfected with pDAS000031 ('pDAS31'). In addition, the FACS sorting results of untransformed canola protoplasts are provided as a negative control.

FIG. 22: Shows the FACS sorting of canola protoplasts and the calculated transfection efficiency of canola ETIP protoplast events which were transformed with pDAS000068/pDAS000074 (top graph) and pDAS000068/pDAS000075 (bottom graph).

DETAILED DESCRIPTION

Figure 2:
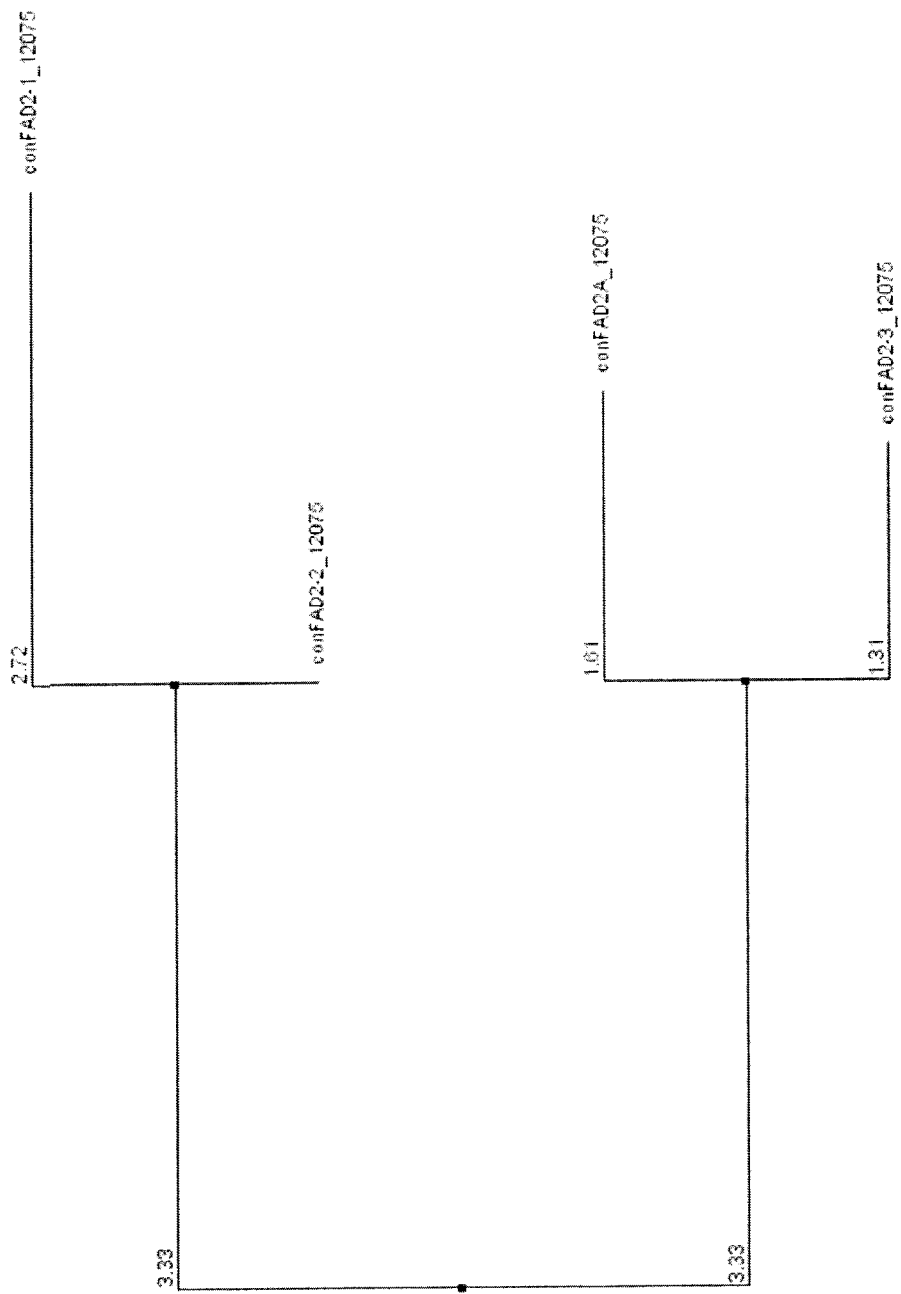
FIG. 2: Shows a phylogenetic tree of FAD2 gene sequences generated using Jalview™ v2.3 based on neighbor joining distances.

Described herein are methods and compositions for the production of an Engineered Transgene Integration Platform (ETIP), comprising a targetable nucleic acid molecule, that is stably integrated into the genome of a plant cell and serves as the host germplasm for transformation and integration of a donor nucleic acid molecule. The disclosure relates to the field of plant precision transformation, gene targeting, targeted genomic integration and protein expression in plants. In a preferred embodiment, an ETIP can be inserted randomly or at targeted locations in plant genomes to facilitate the rapid selection and detection of one or more genes of interest (GOI) that have been targeted (both the 3' and 5' ends) at the ETIP genomic location. In some embodiments, specific double-stranded breaks may be introduced within the ETIP. In other embodiments, a method for selection and enrichment of targeted, isolated cells or protoplasts, followed by the regeneration of fertile plants using flow cytometry and FACS is described.

Particular methods include producing a transgenic plant cell having a stable, heritable genetic modification in the plant and its progeny, as well as the composition of the transgenic plant. In certain embodiments, an ETIP is described for use in a precision plant transformation system, wherein the ETIP comprising an integration nucleic acid is stably integrated into the host germplasm. Other embodiments relate to methods for producing a transgenic plant cell such that the plant cell genomic DNA includes at least one stably-integrated functional marker gene. In some embodiments, the method comprises using a targetable nucleic acid molecule containing one or more targeting site specific nuclease recognition sites, a first fragment of a first marker gene, and a second fragment of a second marker gene. In another embodiment the donor nucleic acid molecule comprises a nucleotide sequence of interest and two nucleic acid sequences flanking the nucleic acid sequence of interest. In another embodiment the two nucleic acid sequences flanking the nucleic acid sequence of interest are a first and second homology arm nucleic acid sequence. In other embodiments the donor nucleic acid molecule is used to transform the plant cell. The homology arm nucleic acid sequences may be homologous with regions of the ETIP or the targetable nucleic acid molecule sequence and may be homologous to the first and second fragment of the first and second marker genes of the targetable nucleic acid molecule.

Also described are compositions of, and methods for producing, transgenic plants wherein the donor nucleic acid molecule expresses one or more products of an exogenous nucleic acid sequence (e.g., a protein or a RNA molecule) that has been stably-integrated into an ETIP or the targetable nucleic acid molecule in a plant cell. In some embodiments, an ETIP or the targetable nucleic acid molecule uses zinc finger nuclease binding sites or a site specific nuclease comprising a protein expressing zinc finger nuclease activity. In alternative embodiments, a site specific nuclease is comprised of other additional targeting technologies such as meganucleases, TALs, RNA-guided CRISPR-Cas9, or leucine zippers. In particular embodiments, the ETIP is a targetable nucleic acid molecule that facilitates the testing of gene candidates and plant expression vector designs of the early development phases of the transgenic plant development process. In some embodiments, a transgenic plant cell includes an integration nucleic acid molecule having a polynucleotide sequence with one or more targeting site specific nuclease recognition sites and a first and second fragment of a first and second marker gene. It is understood that the marker gene fragments may not encode a functional marker gene expression product. Furthermore the marker genes may comprise an intron nucleic acid sequence as an embodiment. In other embodiments, the marker genes may comprise a homology arm nucleic acid sequence.

In some embodiments, one or two or more regions of the donor nucleic acid molecule lacks sequence homology with plant genomic DNA (exogenous). In additional embodiments the donor nucleic acid molecule may comprise homology arm nucleic acid sequence. The homology arm nucleic acid sequences of the donor nucleic acid molecule may be integrated into the regions flanking the site specific nuclease restriction site of the targetable nucleic acid molecule. In certain embodiments, the homology arm sequences may be from 50 bp to 3 kb in length.

In particular embodiments, the donor nucleic acid molecule may comprise exogenous nucleic acid sequences which enable targeting to the ETIP targetable nucleic acid molecule and selection at the 5' and 3' ends for precisely targeted events. Products of an exogenous nucleic acid sequences can comprise, for example, one or more genes or cDNA molecules, or any type of coding or non-coding nucleotide sequence, as well as one or more regulatory gene elements (e.g., promoters). The design of the donor nucleic acid molecule enables excision of coding and non-coding DNA, including but not limited to selectable markers, following selected integration of donor DNA into the ETIP.

In particular embodiments, the ETIP targetable nucleic acid molecule may include a first fragment of a first marker gene and a second fragment of and second marker gene, and the donor nucleic acid molecule containing a corresponding second fragment of the first marker gene and a first fragment of the second marker gene. The first fragment of the first marker gene may be located at the 5' end of the targetable nucleic acid molecule, with the second fragment of the second marker gene located at the 3' end of the targetable nucleic acid molecule, such that stably integrating the donor nucleic acid molecule, comprising the second fragment of the first marker gene and the first fragment of the second marker gene, into the plant cell's genome generates a functional first marker gene and second marker gene. In some embodiments, these marker genes may be used to select for stable integration of the ETIP. In some embodiments, suitable marker genes may include PMI, Xyl(A), YFP, DSR, GFP, GUS, NPTII, AAD-1, AAD-12, DGT-28, AHAS, PAT, DSM-2, HYG, BAR, and fluorescent proteins. In other embodiments the marker gene is a visually screenable marker gene, the presence of which can be determined by monitoring a cell for a change in color. In other embodiments the marker gene is a selectable marker gene (e.g., encoding a herbicide or antibiotic resistance gene) the presence of which is selected for using a herbicide or antibiotic that reduces cell growth. In further embodiments the marker gene is a positive selectable marker gene.

Various selectable markers also described as reporter genes can be incorporated into a chosen expression vector to allow for identification and selectable of transformed plants ("transformants"). Many methods are available to confirm expression of selectable markers in transformed plants, including for example DNA sequencing and PCR (polymerase chain reaction), Southern blotting, RNA blotting, immunological methods for detection of a protein expressed from the vector, e.g., precipitated protein that mediates phosphinothricin resistance, or visual observation of other proteins such as reporter genes encoding β-glucuronidase (GUS), luciferase, green fluorescent protein (GFP), yellow fluorescent protein (YFP), DsRed, β-galactosidase, chloramphenicol acetyltransferase (CAT), alkaline phosphatase, and the like (See Sambrook, et al., Molecular Cloning: A Laboratory Manual, Third Edition, Cold Spring Harbor Press, N.Y., 2001, the content of which is incorporated herein by reference in its entirety).

Selectable marker genes are utilized for selection of transformed cells or tissues. Selectable marker genes include genes encoding antibiotic resistance, such as those encoding neomycin phosphotransferase II (NEO) and hygromycin phosphotransferase (HPT) as well as genes conferring resistance to herbicidal compounds. Herbicide resistance genes generally code for a modified target protein insensitive to the herbicide or for an enzyme that degrades or detoxifies the herbicide in the plant before it can act. For example, resistance to glyphosate has been obtained by using genes coding for mutant target enzymes, 5-enolpyruvylshikimate-3-phosphate synthase (EPSPS). Genes and mutants for EPSPS are well known, and further described below. Resistance to glufosinate ammonium, bromoxynil, and 2,4-dichlorophenoxyacetate (2,4-D) have been obtained by using bacterial genes encoding pat or DSM-2, a nitrilase, an aad-1, or an aad-12 gene, which detoxifies the respective herbicides.

In an embodiment, herbicides can inhibit the growing point or meristem, including imidazolinone or sulfonylurea, and genes for resistance/tolerance of acetohydroxyacid synthase (AHAS) and acetolactate synthase (ALS) for these herbicides are well known. Glyphosate resistance genes include mutant 5-enolpyruvylshikimate-3-phosphate synthase (EPSPs) and dgt-28 genes (via the introduction of recombinant nucleic acids and/or various forms of in vivo mutagenesis of native EPSPs genes), aroA genes and glyphosate acetyl transferase (GAT) genes, respectively). Resistance genes for other phosphono compounds include bar genes from *Streptomyces* species, including *Streptomyces hygroscopicus* and *Streptomyces viridichromogenes*, and pyridinoxy or phenoxy proprionic acids and cyclohexones (ACCase inhibitor-encoding genes). Exemplary genes conferring resistance to cyclohexanediones and/or aryloxyphenoxypropanoic acid (including Haloxyfop, Diclofop, Fenoxyprop, Fluazifop, Quizalofop) include genes of acetyl coenzyme A carboxylase (ACCase)-Acc1-S1, Acc1-S2 and Acc1-S3. In an embodiment, herbicides can inhibit photosynthesis, including triazine (psbA and 1s+ genes) or benzonitrile (nitrilase gene).

In an embodiment, selectable marker genes include, but are not limited to genes encoding: neomycin phosphotransferase II; cyanamide hydratase; aspartate kinase; dihydrodipicolinate synthase; tryptophan decarboxylase; dihydrodipicolinate synthase and desensitized aspartate kinase; bar gene; tryptophan decarboxylase; neomycin phosphotransferase (NEO); hygromycin phosphotransferase (HPT or HYG); dihydrofolate reductase (DHFR); phosphinothricin acetyltransferase; 2,2-dichloropropionic acid dehalogenase; acetohydroxyacid synthase; 5-enolpyruvyl-shikimate-phosphate synthase (aroA); haloarylnitrilase; acetyl-coenzyme A carboxylase; dihydropteroate synthase (sul I); and 32 kD photosystem II polypeptide (psbA).

An embodiment also includes genes encoding resistance to: chloramphenicol; methotrexate; hygromycin; spectinomycin; bromoxynil; glyphosate; and phosphinothricin.

The above list of selectable marker genes is not meant to be limiting. Any reporter or selectable marker gene are encompassed by the present invention.

In an embodiment, the ETIP targetable polynucleotide molecule is integrated into a genomic locus. In one example the FAD2, FAD3, and IPK1 genomic loci may be selected as targets for ETIP integration and subsequent integration of a donor polynucleotide donor molecule. Disruption of the FAD2 and FAD3 endogenous genes has been shown to have no adverse impact on the agronomic or quality properties of the plant cell. Accordingly, no agronomic or quality penalties associated with plant or plant product performance (canola, soybean, corn, etc.), and bundling of traits associated with specific oil quality characteristics accelerates introgression and new germplasm development are observed when the FAD2 and FAD3 sites are disrupted. In particular embodiments, the donor nucleotide sequence molecule may be linked to a regulatory element such as a promoter, intron, 5'UTR or 3'UTR.

The integration of the donor nucleic acid molecule into an ETIP may be facilitated by targeted double-strand cleavage of a site specific nuclease. The site specific nuclease may be located within the ETIP targetable nucleic acid molecule. Moreover, site specific nuclease may be located within the ETIP targetable nucleic acid molecule comprising an Engineered Landing Pad (ELP), see US Patent No. 20110191899, herein incorporated by reference. Furthermore, the site specific nuclease the may be located within or in proximity to an ELP within the selected ETIP. Cleavage may be targeted to an ETIP through the use of fusion proteins comprising a DNA-binding domain, such as a meganuclease DNA-binding domain, RNA-guided CRISPR-Cas9 DNA-binding domain, a leucine zipper DNA-binding domain, a TAL DNA-binding domain, a zinc finger protein (ZFP), zinc finger nuclease, or chimeric combinations of the aforementioned, which are designed to bind an engineered sequence within the selected ETIP. Such cleavage stimulates integration of payload or donor nucleic acid exogenous polynucleotide sequences at or near the cleavage site in the ETIP. Integration of donor nucleic acid molecules using the disclosed methods can proceed through both homology-dependent and homology-independent mechanisms, with the selection of targeted events achieved through screening for novel selectable and or scorable markers which are functional in targeted events at both the 3' and 5' regions of the ETIP. The present disclosure demonstrates the use of novel Engineered Zinc Finger Binding Sites and ZFNs to achieve selected double-strand breaks at the ETIP.

In alternative embodiments, novel engineered DNA-binding domains (e.g., ZFPs, meganucleases, leucine zippers, TALs, RNA-guided CRISPR-Cas9) bind to one or more target sites in an ETIP that do not exist within the native plant cell genome. The DNA-binding domain(s) can include, for example, any of the engineered zinc finger DNA binding domains comprising the recognition helices, such as those described in U.S. application Ser. No. 12/931,096. In some embodiments, any of the DNA binding domains described herein may further comprise a functional domain, for example a cleavage domain or cleavage half-domain. In other embodiments, the cleavage half-domain can be from a Type IIS restriction endonuclease such as FokI or StsI. Further embodiments of the cleavage domain can comprise a homing endonuclease, such as, for example, a homing endonuclease with a modified DNA-binding domain.

Embodiments of the subject disclosure include use of a zinc finger DNA binding protein. A zinc finger DNA binding protein, "ZFP," (or binding domain) is a protein, or a domain within a larger protein, that binds DNA in a sequence-specific manner through one or more zinc fingers, which are regions of amino acid sequence within the binding domain whose structure is stabilized through coordination of a zinc ion. The term zinc finger DNA binding protein is often abbreviated as zinc finger protein or ZFP. Zinc finger binding domains may be "engineered" to bind to a predetermined nucleotide sequence. Non-limiting examples of methods for engineering zinc finger proteins are design and selection. A designed zinc finger protein is a protein not occurring in nature whose design/composition results principally from rational criteria. Rational criteria for design include application of substitution rules and computerized algorithms for processing information in a database storing information of existing ZFP designs and binding data. See, for example, U.S. Pat. Nos. 6,140,081; 6,453,242; 6,534,261; and 6,785,613; see, also WO 98153058; WO 98153059; WO 98153060; WO 21016536 and WO 031016496; and U.S. Pat. Nos. 6,746,838; 6,866,997; and 7,030,215.

In particular embodiments of the subject disclosure, a zinc finger nuclease (ZFN) may be employed. A ZFN may be any zinc finger nuclease that can be delivered to a plant cell according to the subject disclosure. For example, ZFNs may comprise fusion proteins comprising a cleavage domain (or a cleavage half-domain) and a zinc finger binding domain, polynucleotides encoding these proteins and combinations of polypeptides and polypeptide-encoding polynucleotides. A zinc finger binding domain may comprise one or more zinc fingers (e.g., 2, 3, 4, 5, 6, 7, 8, 9 or more zinc fingers), and may be engineered to bind to any region of interest.

Thus, by identifying a target region of interest at which cleavage or recombination is desired, one may, according to the methods disclosed herein, construct one or more fusion proteins comprising a cleavage domain (or cleavage half-domain) and a zinc finger domain engineered to recognize a target sequence in said region of interest. The presence of such a fusion protein (or proteins) in a cell will result in binding of the fusion protein(s) to its (their) binding site(s) and cleavage within or near said region of interest. Moreover, if an exogenous polynucleotide homologous to the region of interest is also present in such a cell, homologous recombination occurs at a high rate between the double strand break nucleotide sequence and the exogenous polynucleotide. For the purposes of this disclosure, "homologous recombination" refers to the specialized form of such exchange that takes place, for example, during repair of double-strand breaks in cells via homology-directed repair mechanisms. This process requires nucleotide sequence homology, uses a "donor" molecule to template repair of a "target" molecule (i.e., the one that experienced the double-strand break), and is variously known as "non-crossover gene conversion" or "short tract gene conversion," because it leads to the transfer of genetic information from the donor to the target. Without wishing to be bound by any particular theory, such transfer can involve mismatch correction of heteroduplex DNA that forms between the broken target and the donor, and/or "synthesis-dependent strand annealing," in which the donor is used to resynthesize genetic information that will become part of the target, and/or related processes. Such specialized homologous recombination often results in an alteration of the sequence of the target molecule such that part or all of the sequence of the donor polynucleotide is incorporated into the target polynucleotide.

In the methods of the disclosure, one or more targeted site specific nucleases as described herein create a double-stranded break in the target sequence (e.g., cellular chromatin) at a predetermined site, and a "donor" polynucleotide, having homology to the nucleotide sequence in the region of the break, can be introduced into the cell. The presence of the double-stranded break has been shown to facilitate integration of the donor sequence. The donor sequence may be physically integrated or, alternatively, the donor polynucleotide is used as a template for repair of the break via homologous recombination, resulting in the introduction of all or part of the nucleotide sequence as in the donor into the cellular chromatin. Thus, a first sequence in cellular chromatin can be altered and, in certain embodiments, can be converted into a sequence present in a donor polynucleotide. Thus, the use of the terms "replace" or "replacement" can be understood to represent replacement of one nucleotide sequence by another, (i.e., replacement of a sequence in the informational sense), and does not necessarily require physical or chemical replacement of one polynucleotide by another.

In some embodiments, site-specific integration may be accomplished by utilizing factors that are capable of recognizing and binding to particular nucleotide sequences, for example, in the genome of a host organism. For instance, many proteins comprise polypeptide domains that are capable of recognizing and binding to DNA in a site-specific manner. A DNA sequence that is recognized by a DNA-binding polypeptide may be referred to as a "target" sequence. Polypeptide domains that are capable of recognizing and binding to DNA in a site-specific manner generally fold correctly and function independently to bind DNA in a site-specific manner, even when expressed in a polypeptide other than the protein from which the domain was originally isolated. Similarly, target sequences for recognition and binding by DNA-binding polypeptides are generally able to be recognized and bound by such polypeptides, even when present in large DNA structures (e.g., a chromosome), particularly when the site where the target sequence is located is one known to be accessible to soluble cellular proteins (e.g., a gene).

While DNA-binding polypeptides identified from proteins that exist in nature typically bind to a discrete nucleotide sequence or motif (e.g., a consensus recognition sequence), methods exist and are known in the art for modifying many such DNA-binding polypeptides to recognize a different nucleotide sequence or motif. DNA-binding polypeptides include, for example and without limitation: zinc finger DNA-binding domains; leucine zippers; UPA DNA-binding domains; GAL4; TAL; LexA; RNA-guided CRISPR-Cas9; a Tet repressor; LacR; and a steroid hormone receptor.

In some examples, a DNA-binding polypeptide is a zinc finger. Individual zinc finger motifs can be designed to target and bind specifically to any of a large range of DNA sites. Canonical $Cys_2His_2$ (as well as non-canonical $Cys_3His$) zinc finger polypeptides bind DNA by inserting an α-helix into the major groove of the target DNA double helix. Recognition of DNA by a zinc finger is modular; each finger contacts primarily three consecutive base pairs in the target, and a few key residues in the polypeptide mediate recognition. By including multiple zinc finger DNA-binding domains in a targeting endonuclease, the DNA-binding specificity of the targeting endonuclease may be further increased (and hence the specificity of any gene regulatory effects conferred thereby may also be increased). See, e.g., Urnov et al. (2005) Nature 435:646-51. Thus, one or more zinc finger DNA-binding polypeptides may be engineered and utilized such that a targeting endonuclease introduced into a host cell interacts with a DNA sequence that is unique within the genome of the host cell.

Preferably, the zinc finger protein is non-naturally occurring in that it is engineered to bind to a target site of choice. See, for example, Beerli et al. (2002) Nature Biotechnol. 20:135-141; Pabo et al. (2001) Ann. Rev. Biochem. 70:313-340; Isalan et al. (2001) Nature Biotechnol. 19:656-660; Segal et al. (2001) Curr. Opin. Biotechnol. 12:632-637; Choo et al. (2000) Curr. Opin. Struct. Biol. 10:411-416; U.S. Pat. Nos. 6,453,242; 6,534,261; 6,599,692; 6,503,717; 6,689,558; 7,030,215; 6,794,136; 7,067,317; 7,262,054; 7,070,934; 7,361,635; 7,253,273; and U.S. Patent Publication Nos. 2005/0064474; 2007/0218528; 2005/0267061, all incorporated herein by reference in their entireties.

An engineered zinc finger binding domain can have a novel binding specificity, compared to a naturally-occurring zinc finger protein. Engineering methods include, but are not limited to, rational design and various types of selection. Rational design includes, for example, using databases comprising triplet (or quadruplet) nucleotide sequences and individual zinc finger amino acid sequences, in which each triplet or quadruplet nucleotide sequence is associated with one or more amino acid sequences of zinc fingers which bind the particular triplet or quadruplet sequence. See, for example, co-owned U.S. Pat. Nos. 6,453,242 and 6,534,261, incorporated by reference herein in their entireties.

Exemplary selection methods, including phage display and two-hybrid systems, are disclosed in U.S. Pat. Nos. 5,789,538; 5,925,523; 6,007,988; 6,013,453; 6,410,248; 6,140,466; 6,200,759; and 6,242,568; as well as WO 98/37186; WO 98/53057; WO 00/27878; WO 01/88197 and GB 2,338,237. In addition, enhancement of binding specificity for zinc finger binding domains has been described, for example, in co-owned WO 02/077227.

In addition, as disclosed in these and other references, zinc finger domains and/or multi-fingered zinc finger proteins may be linked together using any suitable linker sequences, including for example, linkers of 5 or more amino acids in length. See, also, U.S. Pat. Nos. 6,479,626; 6,903,185; and 7,153,949 for exemplary linker sequences 6 or more amino acids in length. The proteins described herein may include any combination of suitable linkers between the individual zinc fingers of the protein.

Selection of target sites; ZFPs and methods for design and construction of fusion proteins (and polynucleotides encoding same) are known to those of skill in the art and described in detail in U.S. Pat. Nos. 6,140,0815; 789,538; 6,453,242; 6,534,261; 5,925,523; 6,007,988; 6,013,453; 6,200,759; WO 95/19431; WO 96/06166; WO 98/53057; WO 98/54311; WO 00/27878; WO 01/60970 WO 01/88197; WO 02/099084; WO 98/53058; WO 98/53059; WO 98/53060; WO 02/016536 and WO 03/016496.

In addition, as disclosed in these and other references, zinc finger domains and/or multi-fingered zinc finger proteins may be linked together using any suitable linker sequences, including for example, linkers of 5 or more amino acids in length. See, also, U.S. Pat. Nos. 6,479,626; 6,903,185; and 7,153,949 for exemplary linker sequences 6 or more amino acids in length. The proteins described herein may include any combination of suitable linkers between the individual zinc fingers of the protein.

In some examples, a DNA-binding polypeptide is a DNA-binding domain from GAL4. GAL4 is a modular transactivator in *Saccharomyces cerevisiae*, but it also operates as a transactivator in many other organisms. See, e.g., Sadowski et al. (1988) Nature 335:563-4. In this regulatory system, the expression of genes encoding enzymes of the galactose metabolic pathway in *S. cerevisiae* is stringently regulated by the available carbon source. Johnston (1987) Microbiol. Rev. 51:458-76. Transcriptional control of these metabolic enzymes is mediated by the interaction between the positive regulatory protein, GAL4, and a 17 bp symmetrical DNA sequence to which GAL4 specifically binds (the UAS).

Native GAL4 consists of 881 amino acid residues, with a molecular weight of 99 kDa. GAL4 comprises functionally autonomous domains, the combined activities of which account for activity of GAL4 in vivo. Ma and Ptashne (1987) Cell 48:847-53); Brent and Ptashne (1985) Cell 43(3 Pt 2):729-36. The N-terminal 65 amino acids of GAL4 comprise the GAL4 DNA-binding domain. Keegan et al. (1986) Science 231:699-704; Johnston (1987) Nature 328: 353-5. Sequence-specific binding requires the presence of a divalent cation coordinated by 6 Cys residues present in the DNA binding domain. The coordinated cation-containing domain interacts with and recognizes a conserved CCG triplet at each end of the 17 bp UAS via direct contacts with the major groove of the DNA helix. Marmorstein et al. (1992) Nature 356:408-14. The DNA-binding function of the protein positions C-terminal transcriptional activating domains in the vicinity of the promoter, such that the activating domains can direct transcription.

Additional DNA-binding polypeptides that may be utilized in certain embodiments include, for example and without limitation, a binding sequence from a AVRBS3-inducible gene; a consensus binding sequence from a AVRBS3-inducible gene or synthetic binding sequence engineered therefrom (e.g., UPA DNA-binding domain); TAL; LexA (see, e.g., Brent & Ptashne (1985), supra); LacR (see, e.g., Labow et al. (1990) Mol. Cell. Biol. 10:3343-56;

Baim et al. (1991) Proc. Natl. Acad. Sci. USA 88(12):5072-6); a steroid hormone receptor (Ellliston et al. (1990) J. Biol. Chem. 265:11517-121); the Tet repressor (U.S. Pat. No. 6,271,341) and a mutated Tet repressor that binds to a tet operator sequence in the presence, but not the absence, of tetracycline (Tc); the DNA-binding domain of NF-κB; and components of the regulatory system described in Wang et al. (1994) Proc. Natl. Acad. Sci. USA 91(17):8180-4, which utilizes a fusion of GAL4, a hormone receptor, and VP 16.

In certain embodiments, the DNA-binding domain of one or more of the nucleases used in the methods and compositions described herein comprises a naturally occurring or engineered (non-naturally occurring) TAL effector DNA binding domain. See, e.g., U.S. Patent Publication No. 20110301073, incorporated by reference in its entirety herein. The plant pathogenic bacteria of the genus Xanthomonas are known to cause many diseases in important crop plants. Pathogenicity of Xanthomonas depends on a conserved type III secretion (T3S) system which injects more than 25 different effector proteins into the plant cell. Among these injected proteins are transcription activator-like (TAL) effectors which mimic plant transcriptional activators and manipulate the plant transcriptome (see Kay et al (2007) Science 318:648-651). These proteins contain a DNA binding domain and a transcriptional activation domain. One of the most well characterized TAL-effectors is AvrBs3 from Xanthomonas campestgris pv. Vesicatoria (see Bonas et al (1989) Mol Gen Genet. 218: 127-136 and WO2010079430). TAL-effectors contain a centralized domain of tandem repeats, each repeat containing approximately 34 amino acids, which are key to the DNA binding specificity of these proteins. In addition, they contain a nuclear localization sequence and an acidic transcriptional activation domain (for a review see Schornack S, et al (2006) J Plant Physiol 163(3): 256-272). In addition, in the phytopathogenic bacteria Ralstonia solanacearum two genes, designated brg11 and hpx17 have been found that are homologous to the AvrBs3 family of Xanthomonas in the R. solanacearum biovar 1 strain GMI1000 and in the biovar 4 strain RS1000 (See Heuer et al (2007) Appl and Envir Micro 73(13): 4379-4384). These genes are 98.9% identical in nucleotide sequence to each other but differ by a deletion of 1,575 bp in the repeat domain of hpx17. However, both gene products have less than 40% sequence identity with AvrBs3 family proteins of Xanthomonas. See, e.g., U.S. Pat. Nos. 8,420,782 and 8,440,431 and U.S. Patent Publication No. 20110301073.

In other embodiments, the nuclease comprises a CRISPR/Cas system. The CRISPR (clustered regularly interspaced short palindromic repeats) locus, which encodes RNA components of the system, and the cas (CRISPR-associated) locus, which encodes proteins (Jansen et al., 2002. *Mol. Microbiol.* 43: 1565-1575; Makarova et al., 2002. *Nucleic Acids Res.* 30: 482-496; Makarova et al., 2006. *Biol. Direct* 1: 7; Haft et al., 2005. *PLoS Comput. Biol.* 1: e60) make up the gene sequences of the CRISPR/Cas nuclease system. CRISPR loci in microbial hosts contain a combination of CRISPR-associated (Cas) genes as well as non-coding RNA elements capable of programming the specificity of the CRISPR-mediated nucleic acid cleavage.

The Type II CRISPR is one of the most well characterized systems and carries out targeted DNA double-strand break in four sequential steps. First, two non-coding RNA, the pre-crRNA array and tracrRNA, are transcribed from the CRISPR locus. Second, tracrRNA hybridizes to the repeat regions of the pre-crRNA and mediates the processing of pre-crRNA into mature crRNAs containing individual spacer sequences. Third, the mature crRNA:tracrRNA complex directs Cas9 to the target DNA via Wastson-Crick base-pairing between the spacer on the crRNA and the protospacer on the target DNA next to the protospacer adjacent motif (PAM), an additional requirement for target recognition. Finally, Cas9 mediates cleavage of target DNA to create a double-stranded break within the protospacer. Activity of the CRISPR/Cas system comprises of three steps: (i) insertion of alien DNA sequences into the CRISPR array to prevent future attacks, in a process called 'adaptation', (ii) expression of the relevant proteins, as well as expression and processing of the array, followed by (iii) RNA-mediated interference with the alien nucleic acid. Thus, in the bacterial cell, several of the so-called 'Cas' proteins are involved with the natural function of the CRISPR/Cas system and serve roles in functions such as insertion of the alien DNA etc.

In certain embodiments, Cas protein may be a "functional derivative" of a naturally occurring Cas protein. A "functional derivative" of a native sequence polypeptide is a compound having a qualitative biological property in common with a native sequence polypeptide. "Functional derivatives" include, but are not limited to, fragments of a native sequence and derivatives of a native sequence polypeptide and its fragments, provided that they have a biological activity in common with a corresponding native sequence polypeptide. A biological activity contemplated herein is the ability of the functional derivative to hydrolyze a DNA substrate into fragments. The term "derivative" encompasses both amino acid sequence variants of polypeptide, covalent modifications, and fusions thereof. Suitable derivatives of a Cas polypeptide or a fragment thereof include but are not limited to mutants, fusions, covalent modifications of Cas protein or a fragment thereof. Cas protein, which includes Cas protein or a fragment thereof, as well as derivatives of Cas protein or a fragment thereof, may be obtainable from a cell or synthesized chemically or by a combination of these two procedures. The cell may be a cell that naturally produces Cas protein, or a cell that naturally produces Cas protein and is genetically engineered to produce the endogenous Cas protein at a higher expression level or to produce a Cas protein from an exogenously introduced nucleic acid, which nucleic acid encodes a Cas that is same or different from the endogenous Cas. In some case, the cell does not naturally produce Cas protein and is genetically engineered to produce a Cas protein.

In a particular embodiment where at least two double strand breaks are made, repairing the double strand breaks may comprise removing the material between the double strand breaks and rejoining the ends of the nucleotide sequence so as to excise the sequences between the double strand breaks. In embodiments, the excised sequences may, without limitation, comprise sequences encoding all or a portion of a nucleotide sequence encoding a highly, more highly, very highly, or most highly expressed protein. In further embodiments the excised sequences may, without limitation, comprise regulatory sequences effecting the expression of a highly, more highly, very highly, or most highly expressed protein. In such embodiments, the expression of the highly, more highly, very highly, or most highly expressed protein is decreased relative to levels of expression prior to cleaving.

In alternative embodiments where at least two double strand breaks are made, repairing the double strand breaks may comprise removing the material between the double strand breaks, replacing it with a donor sequence so as to substitute the sequences between the double strand breaks with the donor sequence. In other embodiments, the removed sequences may, without limitation, comprise sequences encoding all or a portion of a nucleotide sequence encoding a highly, more highly, very highly, or most highly expressed protein. In further embodiments the removed sequences may, without limitation, comprise regulatory sequences effecting the expression of a highly, more highly, very highly, or most highly expressed protein. In such embodiments, the expression of the highly, more highly, very highly, or most highly expressed protein is decreased relative to levels of expression prior to cleaving.

In embodiments where one double strand break is made, repairing the double strand break may comprise inserting a donor sequence into or across the double strand break. In certain embodiments, the donor sequence may be inserted into the coding sequence of a highly, more highly, very highly, or most highly expressed protein. In embodiments, the insertion of such sequence may disrupt the transcription of the coding sequence of a highly, more highly, very highly, or most highly expressed protein through, by way of non-limiting example, the presence of an in-frame stop codon. In further embodiments the donor may, without limitation, disrupt the function of regulatory sequences effecting the expression of a highly, more highly, very highly, or most highly expressed protein. In embodiments, the expression of a highly, more highly, very highly, or most highly expressed protein is decreased relative to levels of expression prior to cleaving.

In yet other embodiments, the donor sequence may encode a protein of interest. In further embodiments, expression of the protein of interest from the donor sequence may be controlled, regulated by, or operatively linked to regulatory sequences present in the donor sequence and/or regulatory sequences present in the sequence into which the donor sequence was inserted. In additional embodiments, a nucleic acid sequence encoding a protein of interest may be provided to the cell separate to or in conjunction with the donor sequence. In some embodiments, the donor sequence may be contained within the same nucleic acid molecule as the sequence encoding a protein of interest.

In other embodiments, the nucleotide sequence encoding a highly, more highly, very highly, or most highly expressed protein nucleotide sequence encoding a highly, more highly, very highly, or most highly expressed protein may be located in, by way of non-limiting example, a genome, a plasmid, a cosmid, artificial chromosome, episome, or other nucleotide structure in the cell.

In one aspect, described herein are double-stranded donor polynucleotides for integration into an endogenous locus of choice following in vivo cleavage of the donor using at least one nuclease. The donor nucleotides include an exogenous sequence (transgene) to be integrated into the endogenous locus and contains at least one target site for a nuclease. The donor nucleotides can include regions of homology (e.g., homology arms) flanking the transgene sequence. Chromosomal homology present in the donor sequence can be in the nuclease binding site. In certain embodiments where the nuclease used to cleave the donor, the nuclease is not the same as the nuclease used to cleave the chromosome and it is possible for there to be no homology between the chromosome and the donor sequence. In other embodiments, the donor molecules are integrated into the endogenous locus via homology-independent mechanisms (e.g., NHEJ). In other embodiments, the double-stranded donor comprises a transgene of at least 1 kb in length and nuclease target site(s) 3' and/or 5' of the transgene for in vivo cleavage. The donor molecule may be, for example, a plasmid. In certain embodiments, the donor is integrated following nuclease-mediated cleavage of the endogenous locus. In any nuclease-mediated integration of the donor molecule, the one or more of the nucleases used to cleave the donor may be the same as one or more of the nucleases used to cleave the endogenous locus. Alternatively, one or more of the nucleases used to cleave the donor may be different from one or more of the nucleases used to cleave the endogenous locus.

In some embodiments, the donor is contained on a plasmid. The donor may be integrated following nuclease-mediated cleavage where the donor is flanked in the plasmid by at least two nuclease cleavage sites. In certain embodiments, the sequence of the nuclease cleavage sites in the donor plasmid is the same as the sequence of the nuclease cleavage site in the chromosomal locus containing an ETIP to be targeted. In other embodiments, the nuclease cleavage sites flanking the donor on the donor-containing plasmid are different from the cleavage site in the ETIP of the chromosome. In additional embodiments, the nuclease cleavage sites flanking the donor in the donor-containing plasmid may not be the same, and also may be different from the nuclease cleavage site in the chromosome. In further embodiments, the donor may be contained on a plasmid flanked by at least two nuclease cleavage sites and may be integrated into a deletion in the ETIP of the chromosome created by the action of two nucleases. In such embodiment, the nuclease cleavage sites flanking the donor on the plasmid and the nuclease cleavage sites of the ETIP in the chromosome may either be the same or may be different. In other embodiments the donor is a plasmid containing only a single nuclease cleavage site and the nuclease cleavage site of the ETIP in the chromosome may either be the same or may be different.

The sequence of interest of the donor molecule may comprise one or more sequences encoding a functional polypeptide (e.g., a cDNA), with or without a promoter. In certain embodiments, the nucleic acid sequence comprises a sequence encoding an antibody, an antigen, an enzyme, a growth factor, a receptor (cell surface or nuclear), a hormone, a lymphokine, a cytokine, a reporter, functional fragments of any of the above and combinations of the above. In embodiments in which the functional polypeptide encoding sequences are promoterless, expression of the integrated sequence is then ensured by transcription driven by an endogenous promoter or other control element in the region of interest. In other embodiments, a tandem cassette can be integrated into the selected site in this manner, the first component of the cassette comprising a promoterless sequence as described above, followed by a transcription termination sequence, and a second sequence, encoding an autonomous expression cassette. Additional sequences (coding or non-coding sequences) can be included in the donor molecule between the homology arms. In additional embodiments, the donor nucleic acid comprises sequences encoding functional RNAs for example, miRNAs or shRNAs.

The disclosed methods and compositions for targeted cleavage may be used to induce mutations in a genomic sequence. Targeted cleavage may also be used to create gene knock-outs or gene knock-downs (e.g., functional genomics or target validation) and to facilitate targeted insertion of a sequence into a genome (i.e., sequence knock-in). Insertion may be by means of replacement of chromosomal sequences through, by way of non-limiting example, homologous recombination or by targeted integration, in which a new sequence (i.e., a sequence not present in the region of interest) is inserted at a predetermined target site. In certain examples, such new sequences may be flanked by sequences homologous to the region of interest in the chromosome. The same methods may also be used to replace a wild-type sequence with a mutant sequence or to convert one allele to a different allele.

The disclosed methods for targeted recombination production of a protein of interest may be used to replace any genomic sequence with a non-identical sequence. For example, a mutant genomic sequence may be replaced by its wild-type counterpart, thereby providing methods for treatment of plant diseases; provide resistance to plant pathogens; increase crop yields, etc. In like fashion, one allele of a gene may be replaced by a different allele using the methods of targeted recombination disclosed herein.

In many of these cases, a region of interest comprises a mutation, and the donor polynucleotide comprises the corresponding wild-type sequence. Similarly, a wild-type genomic sequence may be replaced by a mutant sequence, if such is desirable. For example, overexpression of an oncogene may be reversed either by mutating the gene or by replacing its control sequences with sequences that support a lower, non-pathologic level of expression. Indeed, any pathology dependent upon a particular genomic sequence, in any fashion, may be corrected or alleviated using the methods and compositions disclosed herein.

Targeted cleavage, insertion, excision, and/or recombination may also be used to alter noncoding sequences (e.g., regulatory sequences such as promoters, enhancers, initiators, terminators, splice sites) to alter the levels of expression of a gene product. Such methods may be used, for example, for therapeutic purposes, functional genomics and/or target validation studies.

Targeted modification of chromatin structure may be used to facilitate the binding of fusion proteins to cellular chromatin. In additional embodiments, one or more fusions between a zinc finger binding domain and a recombinase (or functional fragment thereof) may be used, in addition to or instead of the zinc finger-cleavage domain fusions disclosed herein, to facilitate targeted recombination. See, for example, co-owned U.S. Pat. No. 6,534,261 and Akopian et al. (2003) Proc. Natl. Acad. Sci. USA 100:8688-8691. In additional embodiments, the disclosed methods and compositions are used to provide fusions of ZFP binding domains with transcriptional activation or repression domains that require dimerization (either homodimerization or heterodimerization) for their activity. In these cases, a fusion polypeptide comprises a zinc finger binding domain and a functional domain monomer (e.g., a monomer from a dimeric transcriptional activation or repression domain). Binding of two such fusion polypeptides to properly situated target sites allows dimerization so as to reconstitute a functional transcription activation or repression domain.

Furthermore, as disclosed above, the methods and compositions set forth herein may be used for targeted integration of exogenous sequences into a region of interest in the genome of a cell, for example in which cleavage enhances insertion via homology-dependent mechanisms (e.g., insertion of a donor sequence comprising an exogenous sequence together with one or more sequences that are either identical, or homologous but non-identical, with a predetermined genomic sequence (i.e., a target site).

The donor sequence may contain sufficient homology in the regions flanking the exogenous sequence to support homology-directed repair (HDR) of a double-strand break in a genomic sequence, thereby inserting the exogenous sequence at the genomic target site. Therefore, the donor nucleic acid may be of any size sufficient to support integration of the exogenous sequence by homology-dependent repair mechanisms (e.g., homologous recombination). Without wishing to be bound by any particular theory, the regions of homology flanking the exogenous sequence are thought to provide the broken chromosome ends with a template for re-synthesis of the genetic information at the site of the double-stranded break. In certain embodiments, two of the identical sequences or two of the homologous but non-identical sequences (or one of each) are present, flanking the exogenous sequence. An exogenous sequence (or exogenous nucleic acid or exogenous polynucleotide) is one that contains a nucleotide sequence that is not normally present in the region of interest.

It is understood that a construct carrying a ZFN gene under the control of an inducible promoter along with its corresponding recognition sequence can be stably integrated into *Arabidopsis* and shown to introduce targeted mutations resulting from non-homologous end joining at the recognition site. For example, in International Patent Publication No. WO/2008/021207, a method for precision insertion of transgenes is described via ZFN-mediated homologous recombination. Conversely, where the ZFN protein can be expressed and purified outside the target organism and then delivered into target plant cells, surgically specific mutation/ gene knock-out may be induced via non-homologous end joining (NHEJ). Thus, the subject disclosure can produce a non-transgenic genetically modified plant that would bypass restrictions on transgenic crops and process of targeted gene editing will be possible without requiring a transgenic approach.

Targeted gene addition is typically performed by transfection of a selectable marker gene flanked by a substantial amount of DNA homologous to the target locus. Spontaneous double stranded breaks (DSBs) are formed at the target locus, likely from stalled DNA replication forks. While normally repaired inerrantly by homology-directed repair (HDR) templated by the sister chromosome, HDR can instead use the homologous donor DNA to heal the break. When an additional DNA sequence is inserted between the two regions of homology in the donor plasmid, the cellular DNA repair machinery unwittingly copies this genetic information into the chromosome. As this homology-based targeting relies on the capture of very rare DSBs within the region of donor homology, extensive homology to the target locus is needed to obtain targeted integration at a useful frequency.

In alternative embodiments, similar gene addition capability can be provided to cell types lacking efficient homology-based DNA repair via NHEJ. Such an approach might prove particularly useful for gene addition in primary, non-dividing cells which preferentially use the NHEJ DNA repair pathway. Gene addition via NHEJ can also be useful for unsequenced genomes as donor construction without a genome sequence that requires arduous preliminary cloning and sequencing. It is understood that non-specific DNA can be captured at the site of NHEJ-mediated DSB repair. In a particular embodiment, the information present in the single-stranded overhangs created by ZFN cleavage can be used to perform targeted DNA integration using the NHEJ DNA repair machinery.

In other embodiments, gene addition capability can be provided by both efficient homology-based DNA repair via NHEJ and via homology directed repair. In such an embodiment one end of a donor sequence is integrated within a chromosomal target via NHEJ and the other end of the donor sequence is integrated within the chromosomal target via homology directed repair.

Figure 17:
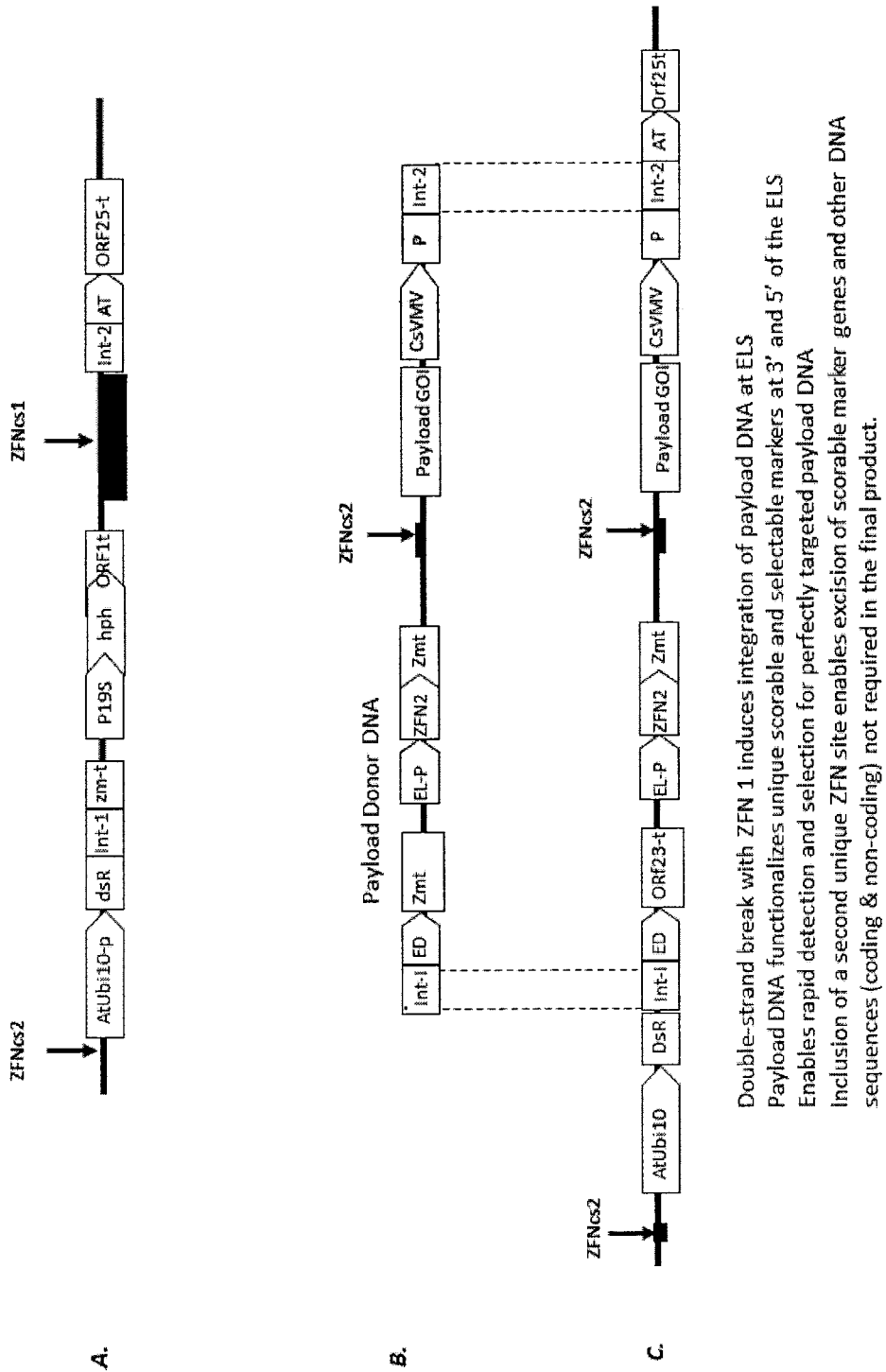
FIG. 17: Illustrates an ETIP and payload nucleic acid configuration, as well as the product of the targeted Payload at the ETIP site in the plant cell genome.

Certain embodiments include methods for production of a donor or payload DNA that expresses one or more products of an exogenous nucleic acid sequence (i.e. a protein or a RNA molecule) that has been stably integrated into an ETIP in a plant cell (FIG. 17).

Figure 18:
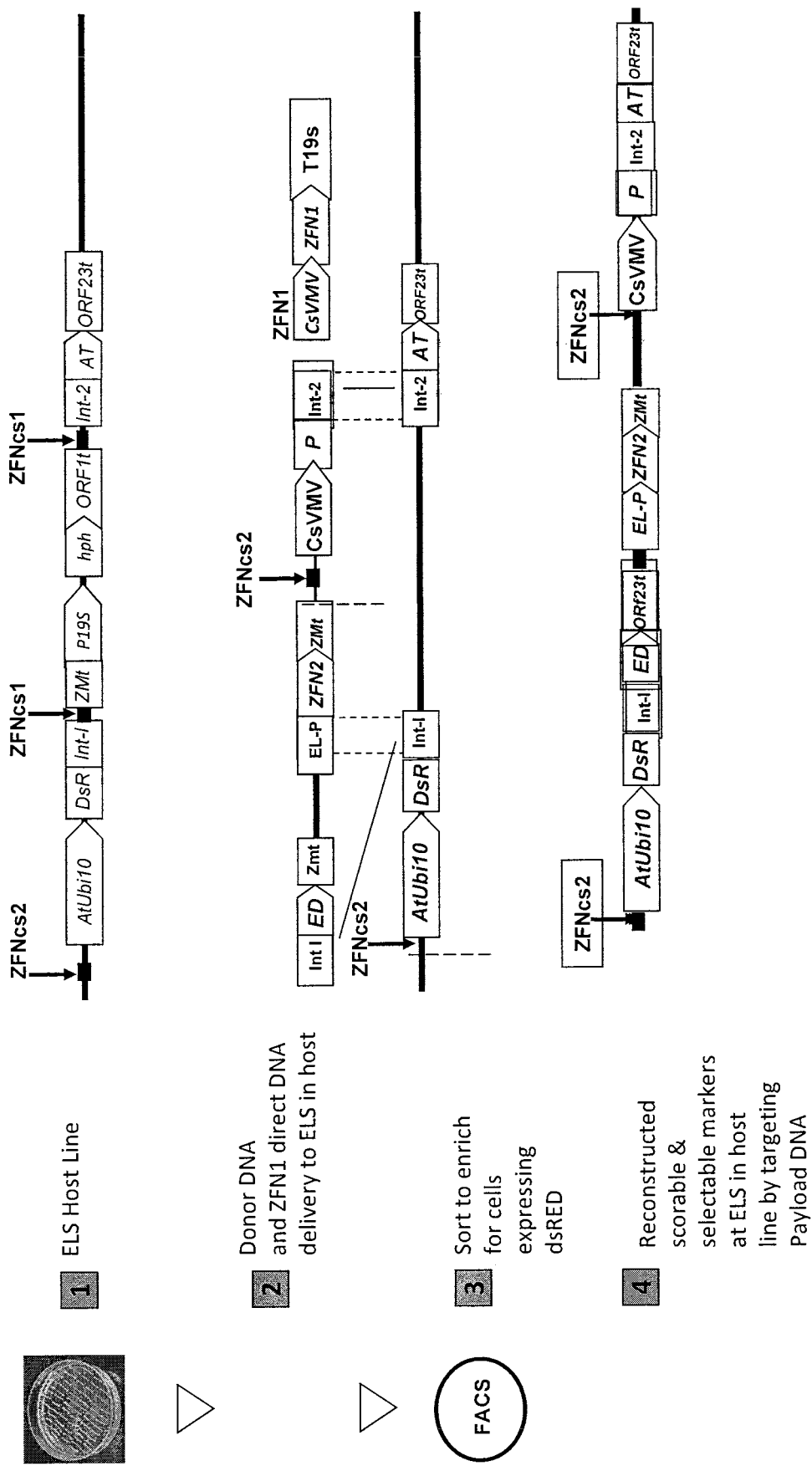
FIG. 18: Illustrates transformation of protoplast cells followed by FACS selection of targeted Payload DNA at the ETIP in the host line using reconstruction of truncated scorable and selectable markers at both the 3' and 5' ends.

Alternative embodiments of the disclosure include the integration of marker genes and subsequent expression of the marker protein which have been incorporated into the ETIP targetable nucleic acid molecule. In some embodiments, methods for the selection of targeted donor DNA into ETIP locus use cell sorting and selection for expression of marker genes incorporated at one or both the 5' and 3' ends of the ETIP (FIG. 18). The integration of the ETIP at or near the FAD2, FAD3 or IPK2 locus or the integration of the ETIP within random locations in the plant genome do not appear to impair the ability of the host plant to regenerate, flower, produce seed and enables the selection, regeneration and heritable transmission of subsequent exogenous nucleic acid sequence products delivered by the donor polynucleotide molecule which are targeted to the ETIP over generations.

Furthermore, the ETIP can be used to reduce the number of transgenic events that need to be produced in traditional event introgression experiments, because the candidate genes and plant expression vector designs are integrated within the same endogenous plant genome location. The ETIP technology can be deployed across all plant species, including crops and model species including corn, soybean, rice, canola, wheat, barley, sunflower, tomato, *Arabidopsis*, cotton, potato, sorghum, forage grasses, *Brassica* species (including, but not limited to, *B. napus, B. rapa, B. oleracea, B. nigra, B. juncea, B. carrinata*), sugarcane sugar beets, *Brachypodium*, and alfalfa).

A particular embodiment includes the transgenic plant or transgenic plant cell generated using the methods described herein. Specifically, in one embodiment, a transgenic plant cell includes a nucleic acid molecule that has a nucleotide sequence (which may be genomic) containing at least one targetable nucleic acid molecule, wherein the targetable nucleic acid molecule comprises a site specific nuclease recognition site and a fragment of at least one marker gene, where the fragment does not encode a functional marker gene expression product. Particular embodiments of the targetable nucleic acid molecule may include a first fragment of a first marker gene and a second fragment of a second marker gene. Other embodiments of the targetable nucleic acid molecule may include one or more gene expression cassettes. In further embodiments, the first and second fragments may flank the site specific nuclease recognition site.

In some embodiments, the donor nucleotide sequence may be operably linked to a regulatory element, such as a promoter, a 5' UTR, a 3' UTR, an intron, or a MAR. In other embodiments, the nucleotide sequence may comprise fragments of two marker genes.

The ETIP system represents a platform technology which enables rapid selection of targeted integration of a donor sequence into plant genomes. In certain embodiments, the ETIP technology may be used in plant cell cultures, as well as algae, moss, fungal systems, and mammalian cell cultures, such as NK-1, CHO, etc. The ETIP system forms the basis for the development of precision plant transformation system in different crop species to enable high through put gene and construct testing at throughout the trait development process.

All references, including publications, patents, and patent applications, cited herein are hereby incorporated by reference to the extent they are not inconsistent with the explicit details of this disclosure, and are so incorporated to the same extent as if each reference were individually and specifically indicated to be incorporated by reference and were set forth in its entirety herein. The references discussed herein are provided solely for their disclosure prior to the filing date of the present application. Nothing herein is to be construed as an admission that the inventors are not entitled to antedate such disclosure by virtue of prior invention.

EXAMPLES

The following Examples are provided to illustrate certain particular features and/or aspects. These Examples should not be construed to limit the disclosure to the particular features or aspects described.

Example 1

Identification of Paralogous FAD2 and FAD3 Target Sequences from a Bacterial Artificial Chromosome Library BAC Construction A Bacterial Artificial Chromosome (BAC) library was sourced from a commercial vendor (Amplicon Express, Pullman, Wash.). The BAC library consisted of 110,592 BAC clones containing high molecular weight genomic DNA (gDNA) fragments isolated from *Brassica napus* L. var. DH10275. The gDNA was digested with either the BamHI or HinDIII restriction enzyme. Isolated gDNA fragments of about 135 Kbp were ligated into the pCC1BAC vector (Epicentre, Madison, Wis.) and transformed into *Escherichia coli* str. DH10B (Invitrogen). The BAC library was made up of an even number of BAC clones that were constructed using the two different restriction enzymes. As such, the Hind III constructed BAC library consisted of 144 individual 384-well plates. Likewise, the BamHI constructed BAC library consisted of 144 individual 384-well plates. A total of 110,592 BAC clones were isolated and arrayed into 288 individual 384-well plates. Each of the 288 individual 384 well plates were provided by the vendor as a single DNA extraction for rapid PCR based screening. The resulting BAC library covers approximately 15 Gbp of gDNA, which corresponds to a 12-fold genome coverage of *Brassica napus* L. var. DH10275genome (estimate of the *Brassica napus* L. genome is ca. 1.132 Gbp as described in Johnston et al. (2005) Annals of Botany 95:229-235).

Sequence Analysis of FAD2 Coding Sequences Isolated from the BAC Library

The constructed BAC library was used to isolate FAD2 gene coding sequences. Sequencing experiments were conducted to identify the specific gene sequences of four FAD2 gene paralogs from *Brassica napus* L. var. DH10275.

The FAD2 gene sequence was initially identified within the model species *Arabidopsis thaliana*. The gene sequence is listed in Genbank as Locus Tag: At3g12120. Comparative genomic relationships between the model plant species *Arabidopsis thaliana* and the diploid *Brassica rapa*, one of the progenitors of the tetraploid *Brassica napus*, have been previously described. (Schranz et al. (2006) Trends in Plant Science 11(11):535-542). With specific relation to the FAD2 gene the comparative analysis predicted that 3-4 copies of the gene may occur within the diploid *Brassica* genome. Additional genetic mapping studies were completed by Scheffler et al. (1997) Theoretical and Applied Genetics 94;

583-591. The results of these genetic mapping studies indicated that four copies of the FAD2 gene were present in *Brassica napus*.

Sequencing analysis of the BAC library which was constructed from *B. napus* L. var. DH12075 resulted in the isolation of four BAC sequences (SEQ ID NO:1, SEQ ID NO:2, SEQ. ID NO:3, and SEQ ID NO:4) from which the coding sequences for the FAD2A (SEQ ID NO:5), FAD2-1 (SEQ ID NO:6), FAD2-2 (SEQ ID NO:7), and FAD2-3 (SEQ ID NO:8) genes were determined. The FAD2A, FAD2-1, FAD2-2, and FAD2-3 gene sequences were identified and genetically mapped. Sequence analysis of the four FAD2 genes was conducted using a sequence alignment program and a neighbor-joining tree using percentage of identity. The sequence alignment was made via the AlignX® program from the Vector NTI Advance 11.0 computer program (Life Technologies, Carlsbad, Calif.) and is shown in FIG. 1. AlignX® uses a modified Clustal W algorithm to generate multiple sequence alignments of either protein or nucleic acid sequences for similarity comparisons and for annotation. The neighbour-joining tree was created with Jalview v2.3® software and is shown in FIG. 2. (Waterhouse et al. (2009) Bioinformatics 25 (9) 1189-1191). As shown in FIG. 2, the analysis of the isolated sequences indicated that the FAD2A and FAD2-3 sequences shared high levels of sequence similarity and that, likewise, FAD2-1 and FAD2-2 shared high levels of sequence similarity. The four sequences can be categorized in two clades, wherein FAD2A and FAD2-3 comprise a first Glade, and FAD2-1 and FAD2-2 comprise a second Glade.

Next, the newly isolated FAD2 sequences from *Brassica napus* were used to BLAST genomic libraries isolated from a *Brassica rapa* genomic BAC library and *Brassica oleracea* shotgun genomic sequence reads. Both, *Brassica rapa* and *Brassica oleracea* are diploid progenitors of *Brassica napus* which is an amphidiploid species (AC genome, n=19). *Brassica napus* derived from a recent hybridization event between *Brassica rapa* (A sub-genome, n=10) and *Brassica oleracea* (C sub-genome, n=9). The diploid progenitor sequences were compared to the four different FAD2 coding sequences isolated from *Brassica napus* using a BLASTn analysis. This sequence analysis identified specific, annotated gene sequences from *Brassica rapa* and *Brassica oleracea* which shared the highest sequence similarity to the newly discovered *Brassica napus* FAD2 sequences. Table 1 lists the newly identified FAD2 coding sequence and the corresponding progenitor reference sequence accession number and source organism.

TABLE 1

FAD2 sequences from *Brassica napus* and the corresponding progenitor organism and related FAD sequence accession number.

| Isolated gene sequence | Progenitor organism and sequence accession number | |
|---|---|---|
| FAD2A | *B. rapa* | Genbank Accession No: KBrB063G23 (A05) |
| FAD2-3 | *B. oleracea* | Genbank Accession No: GSS23580801 |
| FAD2-1 | *B. rapa* | Genbank Accession No: KBrB130I19 |
| FAD2-2 | *B. oleracea* | Genbank Accession No: GSS 17735412 |

The FAD2 genes exist in the *Brassica napus* genome as two copies of each gene per sub-genome. One copy of each gene is located on the A sub-genome, and likewise one copy of each gene is located on the C sub-genome. New naming conventions are described to indicate which sub-genome that each gene is located on. The high levels of sequence similarity between the four different FAD2 coding sequences isolated from the *Brassica napus* BAC genomic DNA library and the progenitor sequence data suggest that FAD2-3 is a duplicate of the FAD2 sequence from the C sub-genome and could be relabeled as FAD2C; FAD2-1 is a duplicate of the FAD2 sequence from the A sub-genome and could therefore be labeled as FAD2A'; and finally, FAD2-2 is a second copy that was duplicated from the FAD2 sequence of the C sub-genome and could be labeled as FAD2C'.

Sequence Analysis of FAD3 Coding Sequences Isolated from the BAC Library

The constructed BAC library was used to isolate FAD3 gene coding sequences. Sequencing experiments were conducted to identify the specific gene sequences of five FAD3 gene paralogs from *Brassica napus* L. var. DH10275.

The FAD3 gene sequence was initially identified within the model species *Arabidopsis thaliana*. The gene sequence is listed in Genbank as Locus Tag: At2g29980. Comparative genomic relationships between the model plant species *Arabidopsis thaliana* and the diploid *Brassica rapa*, one of the progenitors of the tetraploid *Brassica napus*, have been previously described. (Schranz et al. (2006) Trends in Plant Science 11(11):535-542). With specific relation to the FAD gene the comparative analysis predicted that 3-4 copies of the gene may occur within the diploid *Brassica* genome. Additional genetic mapping studies were completed by Scheffler et al. (1997) Theoretical and Applied Genetics 94; 583-591. The results of these genetic mapping studies indicated that six copies of the FAD3 gene were present in *Brassica napus*.

Previous sequencing efforts focused on the FAD3 genes from *Brassica napus* had identified and genetically mapped both A and C genome specific copies (Hu et al., (2006) Theoretical and Applied Genetics, 113(3): 497-507). A collection of EST sequences from seed specific cDNA libraries had previously been constructed and sequenced from the plant line DH12075 by Andrew Sharpe of Agriculture and Agri-food Canada, 107 Science Place, Saskatoon, Saskatchewan. As a collection of ESTs from the doubled haploid canola plant DH12075 full length gene sequences were not available, moreover the indications of sequence quality and confidence of correctly called nucleotides was also not available. Consequently, sequence variation between different FAD gene sequence reads could not be unequivocally attributed to different gene copies of the various paralogs of the FAD3 gene family, nor was the genomic sequence available. However, when a combined sequence analysis was performed with the ESTs as well as the two FAD3A and FAD3C full length gene sequences described in Hu et al., (2006), ESTs that matched both of the genes were identified along with an additional 3 haplotypes. As a result, a total of six unique haplotypes of FAD3 were identified. Following the assembly of all available data for the various FAD3 haplotypes, high levels of exon sequence divergence in exon 1 was identified. The divergence of the FAD3 sequence in exon 1 was identified as an opportunity which could be utilized for the design of gene/allele specific PCR primers. In addition, exons were identified that were either minimally differentiated between haplotypes (e.g., exons 5, 6, 7 and 8 had 1-3 bp that varied between FAD3A and FAD3C) or that were devoid of sequence variation (e.g., exons 2 and 3).

Sequencing analysis of the BAC library which was constructed from *B. napus* L. var. DH12075 resulted in the isolation of six BAC sequences (SEQ ID NO:9, SEQ ID NO:10, SEQ ID NO:11, SEQ ID NO:12, SEQ ID NO:13, and SEQ ID NO:14) from which the coding sequences for the FAD3A (SEQ ID NO:15), FAD3A' (SEQ ID NO:16), FAD3A" (SEQ ID NO:17), FAD3C (SEQ ID NO:18), FAD3C" (SEQ ID NO:19), and FAD3C' (SEQ ID NO:20) genes were determined. The FAD3A, FAD3A', FAD3A", FAD3C, FAD3C", and FAD3C' gene sequences were identified and genetically mapped.

Figure 3I:
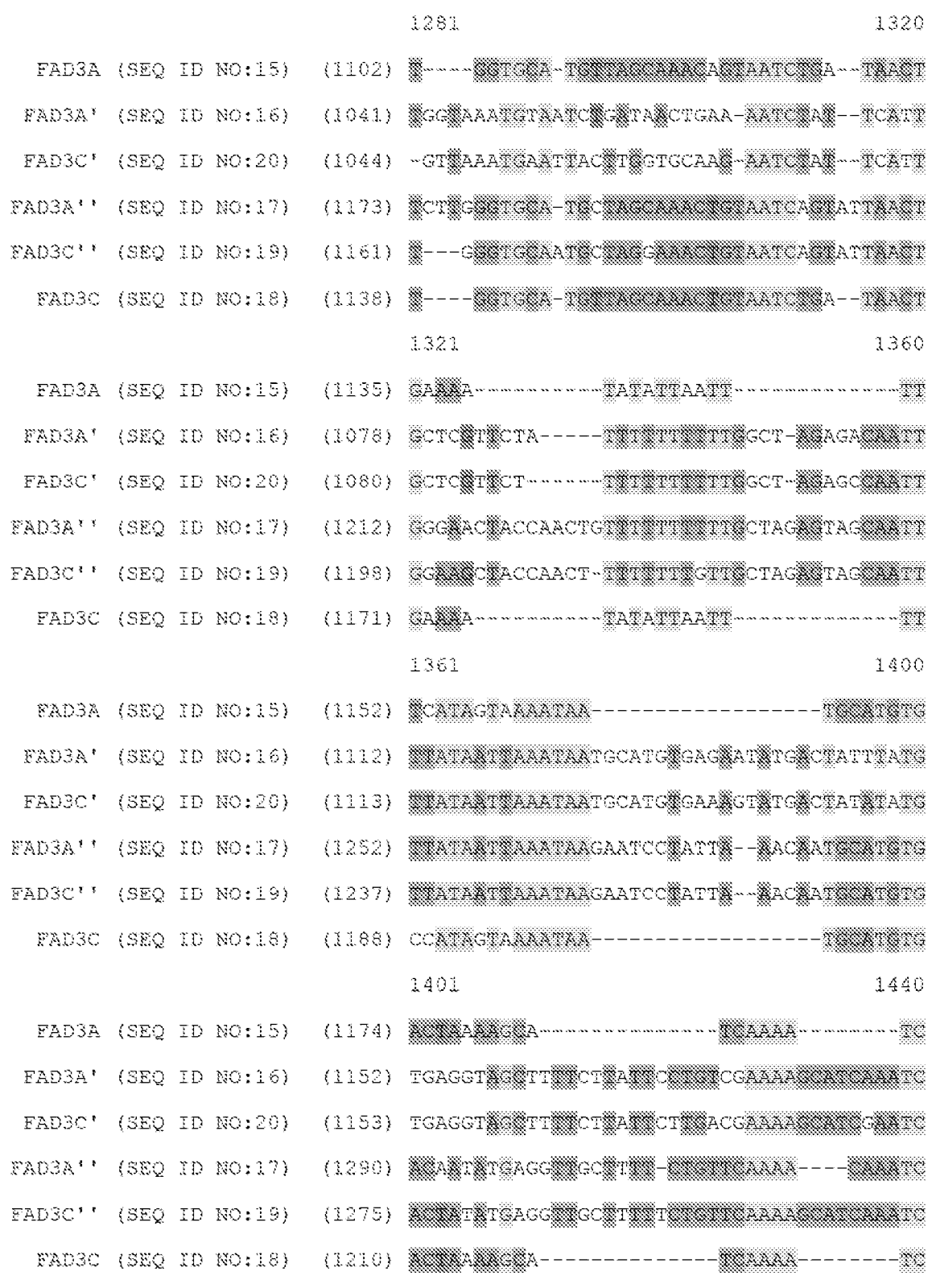
Figure 3L:
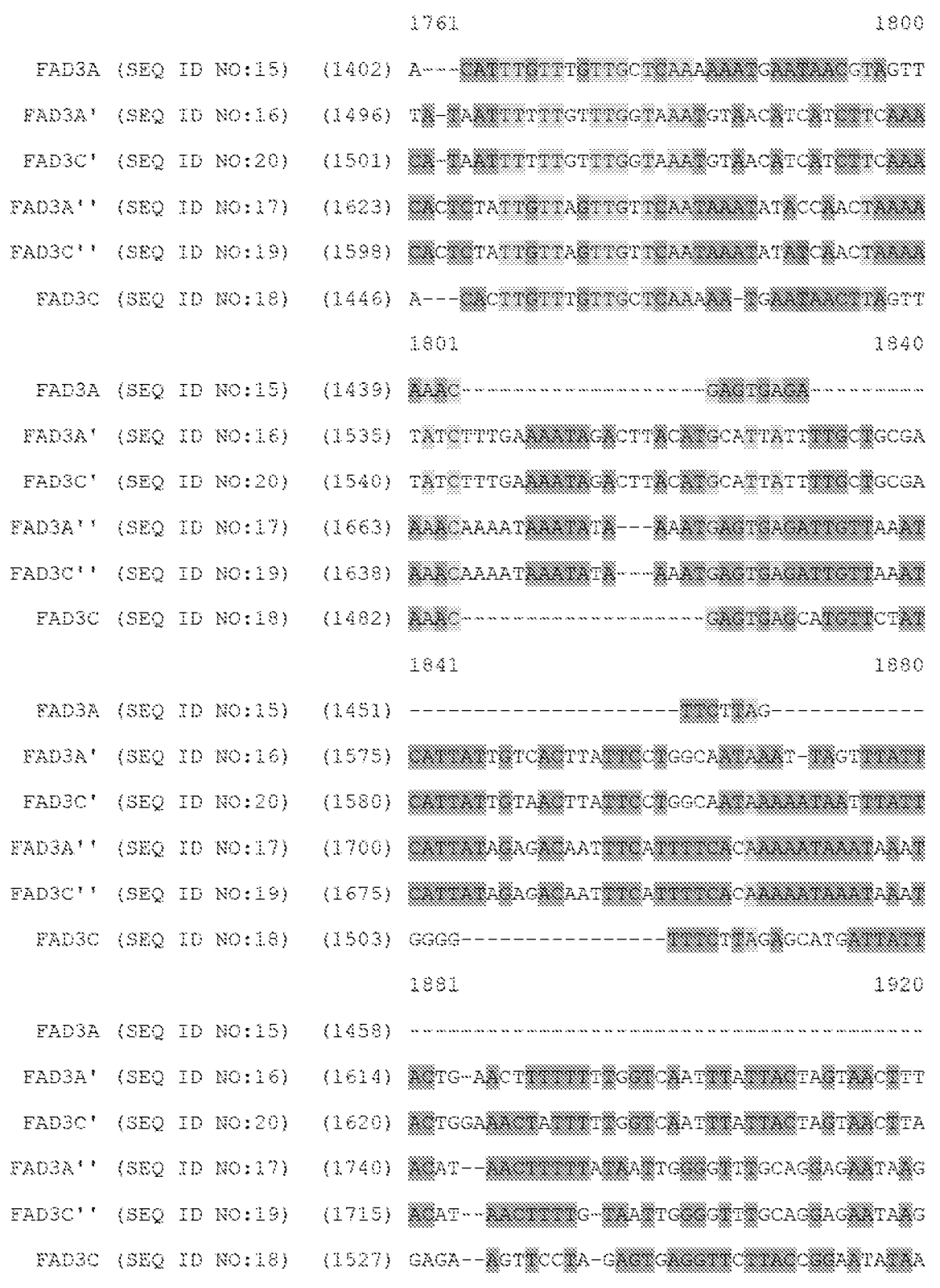
Figure 4:
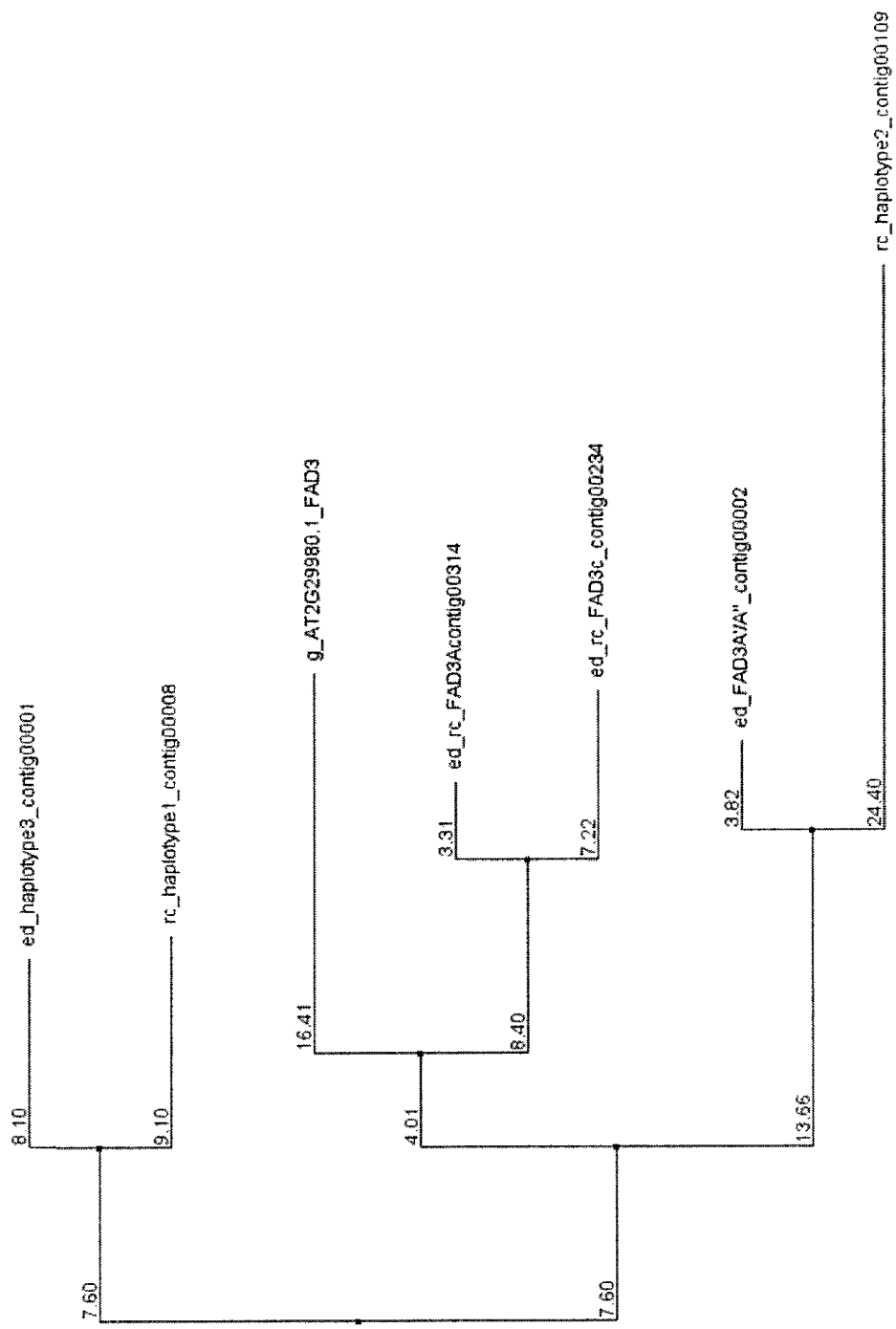
FIG. 4: Shows a phylogenetic tree of FAD3 gene sequences generated using Jalview™ v2.3 based on neighbour joining distances. The labeled sequences correspond as follows: FAD3A'/A" is described throughout this application as FAD3A'; Haplotype2 is described throughout the application as FAD3C'; Haplotype 1 is described throughout the application as FAD3C"; and, Haplotype 3 is described throughout the application as FAD3A".

Sequence analysis of the six FAD3 genes was conducted using a sequence alignment program and a neighbor-joining tree using percentage of identity. The sequence alignment was made via the AlignX® program from the Vector NTI Advance 11.0 computer program (Life Technologies, Carlsbad, Calif.) and is shown in FIG. 3. AlignX® uses a modified Clustal W algorithm to generate multiple sequence alignments of either protein or nucleic acid sequences for similarity comparisons and for annotation. The neighbour-joining tree was created with Jalview v2.3® software and is shown in FIG. 4. (Waterhouse et al. (2009) Bioinformatics 25 (9) 1189-1191). The contigs identified as containing FAD3 genes were used as BLASTn queries against a database of *Arabidopsis thaliana* genes. The region of each of the 6 contigs containing the FAD3 gene was identified through comparison to the *Arabidopsis thaliana* FAD3 gene (Genbank Accession No: At2g29980). The FAD3 contigs were then orientated such that all FAD3 genes were in the 5' to 3' orientation. FAD3 contigs were trimmed to contain as many as 2 upstream (5') and 1 downstream (3') *Arabidopsis thaliana* genes where possible. Once orientated the complete coding region of the FAD3 genes were extracted from each contig and used to generate a Neighbour joining tree to display the relationship between the different FAD3 gene family members. The 6 FAD3 family members were aligned into 3 pairs of FAD3 genes (FIG. 4).

PCR Based Screening

A cohort of PCR primers were design to screen the aforementioned BAC library. The primers were designed as either universal primers, which would amplify all members of the gene family, or as gene specific primers for targeted allele amplification. The PCR primers were designed to be 20 bp long (+/−1 bp) and contain a G/C content of 50% (+/−8%). Table 2 and Table 3 lists the primers which were designed and synthesized. The clones of the BAC library were pooled and screened via the Polymerase Chain Reaction (PCR).

TABLE 2

Primer sequences used for PCR amplification of FAD3 sequences.

| Primer Name: | SEQ ID NO: | Sequence: |
|---|---|---|
| D_uni_F3_F1 | SEQ ID NO: 21 | GAATAAGCCATCGGACACAC |
| D_spec_F3_F2 | SEQ ID NO: 22 | ATGCGAACGGAGACGAAAGG |
| D_spec_F3_F3 | SEQ ID NO: 23 | TGTTAACGGAGATTCCGGTG |
| D_spec_F3_F4 | SEQ ID NO: 24 | GTAGCAATGTGAACGGAGAT |
| D_uni_F3_R1 | SEQ ID NO: 25 | CAGTGTATCTGAGCATCCG |
| D_spec_F3_R2 | SEQ ID NO: 26 | GTGGCCGAGTACGAAGATAG |
| D_spec_F3_R3 | SEQ ID NO: 27 | CAGTAGAGTGGCCAGAGGA |

TABLE 3

PCR primer sequences designed for BAC library screening for FAD2 gene identification.

| Primer Name | SEQ ID NO: | Sequence |
|---|---|---|
| D_UnivF2_F1 | SEQ ID NO: 28 | ATGGGTGCAGGTGGAAGAATG |
| D_UnivF2_F2 | SEQ ID NO: 29 | AGCGTCTCCAGATATACATC |
| D_UnivF2_R1 | SEQ ID NO: 30 | ATGTATATCTGGAGACGCTC |
| D_UnivF2_R2 | SEQ ID NO: 31 | TAGATACACTCCTTCGCCTC |
| D_SpecificF2_F3 | SEQ ID NO: 32 | TCTTTCTCCTACCTCATCTG |
| D_SpecificF2_R3 | SEQ ID NO: 33 | TTCGTAGCTTCCATCGCGTG |
| D_UnivF2_F4 | SEQ ID NO: 34 | GACGCCACCATTCCAACAC |
| D_UnivF2_R4 | SEQ ID NO: 35 | ACTTGCCGTACCACTTGATG |

A Two different sets of conditions were used for the polymerase chain reactions (PCR). The first series of PCR reactions contained: 1×PCR buffer (containing dNTPs); 1.5 mM $MgCl_2$; 200 µM of 0.25 U Immolase® DNA polymerase (Bioline, London, UK); 250 nM of each primer; and, about 5-10 ng template DNA. A second series of PCR reactions were developed for the amplification of genomic DNA and contained: 5-10 ng of genomic DNA, 1×PCR buffer, 2 mM dNTPs, 0.4 µM forward and reverse primer, and 0.25 U Immolase® DNA polymerase (Bioline, London, UK). Amplifications were pooled into a final volume of 13 µL and amplified using an MJ PTC200® thermocycler (BioRad, Hercules, Calif.) or an ABI 9700 Gene Amp System® (Life Technologies, Carlsbad, Calif.). PCR based screening of specific plates was conducted using a 4 dimension screening approach based on the screening system described by Bryan et al (Scottish Crops Research Institute annual report: 2001-2002) with the above described PCR conditions. Following PCR based screening of pooled BAC libraries; the amplified PCR product was sequenced using a direct Sanger sequencing method. The amplified products were purified with ethanol, sodium acetate and EDTA following the BigDye® v3.1 protocol (Applied Biosystems) and electrophoresis was performed on an ABI3730xl® automated capillary electrophoresis platform.

Following PCR based screening and conformational Sanger sequencing, a collection of plates were identified that contained the various different FAD2 and FAD3 gene family members. A total of four unique FAD2 and FAD3 paralogous gene sequences were identified (Table 4 and Table 5). A total of two plates per each FAD2 and FAD3 paralogous gene sequence were chosen to undergo plate screening to identify the specific well and clone within the plate that contained the FAD2 and FAD3 gene (Table 4 and Table 5). The specific wells were identified for both of the plates and an individual clone was selected for each of the FAD2 and FAD3 gene family members.

TABLE 4

Identification of the BAC clone plates that provided positive reaction with the detailed PCR primer combinations, along with two plate identities that were taken forward for clone identification within the plate.

| Gene Name | Primer Sets | Positive Plate Pools | Chosen Plates | Well Id |
|---|---|---|---|---|
| FAD2A | F4 + R1, F1 + R1, F1 + R4, F3 + R3 | 8, 27, 30, 83, 109, 147, 180, 199, 209, 251, 288 | Plate 199 Plate 27 | L23 D20 |
| FAD2-1 | F1 + R4, F4 + R1, F1 + R1, F2 + R2 | 12, 89, 123, 148, 269 | Plate 123 Plate 148 | N17 B15 |
| FAD2-2 | F4 + R1, F1 + R1, F1 + R4, F2 + R2 | 24, 44, 46, 47, 80, 91, 104, 110, 119, 121, 124, 248 | Plate 44 Plate 121 | H03 A17 |
| FAD2-3 | F1 + R4, F4 + R1, F1 + R1, F3 + R3 | 8, 62, 113, 205, 276 | Plate 62 Plate 205 | I16 K11 |

TABLE 5

Identification of the BAC clone plates that provided positive reaction with the detailed PCR primer combinations, along with two plate identities that were taken forward for clone identification within the plate.

| Gene Name | Primer Sets | Positive Plate Pools | Chosen Plates |
|---|---|---|---|
| FAD3A (FAD3A-1) | F2 + R2 | 16, 231 | Plate 16 Plate 231 |
| FAD3C | F4 + R2 | 18, 27, 136, 178, 211, 232 | Plate 18 Plate 27 |
| FAD3C'' (Haplotype1) | F4 + R2, F4 + R3, F3 + R3 | 23, 44, 53, 56, 77, 116, 158, 199, 209, 278, 280, 282, 283, 284, 286 | Plate 44 Plate 199 |
| FAD3A' (FAD3A'/FAD3A'') | F4 + R2 | 52, 121, 139 | Plate 121 Plate 139 |
| FAD3C' (Haplotype2) | F4 + R2 | 144, 188, 235 | Plate 144 Plate 188 |
| FAD3A'' (Haplotype3) | F4 + R3 and F3 + R3 | 69, 105, 106, 229, 242, 247, 248 | Plate 69 Plate 106 |

The single BAC clone, for each identified FAD gene family member, was further analysed via sequencing. The DNA was isolated for the BAC clone and was prepared for sequencing using a Large Construct Kit® (Qiagen, Valencia, Calif.) following the manufacturer's instructions. The extracted BAC DNA was prepared for sequencing using GS-FLX Titanium Technology® (Roche, Indianapolis, Ind.) following manufacturer's instructions. Sequencing reactions were performed using a physically sectored GS-FLX TI Pico-titer Plate® with the BACs pooled in pairs for optimal data output. The BACs were combined in pairs where the FAD2 gene was paired with a FAD3 gene. All generated sequence data was assembled by Newbler v2.0.01.14® (454 Life Sciences, Branford, Conn.). The assembled contigs were manually assessed for the presence of the corresponding FAD gene using Sequencher v3.7® (GeneCodes, Ann Arbor, Mich.).

After the full genomic sequence of all four FAD2 and six FAD3 genes had been identified and fully characterized, zinc finger nucleases were designed to bind to the sequences for each specific gene family member.

Example 2

Design of Zinc Finger Binding Domains Specific to FAD2 Genes

Zinc finger proteins directed against DNA sequences encoding various functional sequences of the FAD2 gene locus were designed as previously described. See, e.g., Urnov et al. (2005) Nature 435:646-651. Exemplary target sequence and recognition helices are shown in Table 6 and Table 7 (recognition helix regions designs) and Table 8 and Table 9 (target sites). In Table 8 and Table 9, nucleotides in the target site that are contacted by the ZFP recognition helices are indicated in uppercase letters; non-contacted nucleotides indicated in lowercase. Zinc Finger Nuclease (ZFN) target sites were designed to bind five target sites of FAD2A, and seven target sites of FAD3. The FAD2 and FAD3 zinc finger designs were incorporated into zinc finger expression vectors encoding a protein having at least one finger with a CCHC structure. See, U.S. Patent Publication No. 2008/0182332. In particular, the last finger in each protein had a CCHC backbone for the recognition helix. The non-canonical zinc finger-encoding sequences were fused to the nuclease domain of the type IIS restriction enzyme FokI (amino acids 384-579 of the sequence of Wah et al., (1998) Proc. Natl. Acad. Sci. USA 95:10564-10569) via a four amino acid ZC linker and an opaque-2 nuclear localization signal derived from Zea mays to form FAD2A zinc-finger nucleases (ZFNs). Expression of the fusion proteins was driven by a relatively strong constitutive promoter such as a promoter derived from the Cassava Vein Mosaic Virus (CsVMV) promoter and flanked by the Agrobacterium tumefaciens ORF23 3'UnTranslated Region (AtuORF23 3'UTR v1). The self-hydrolyzing 2A encoding nucleotide sequence from Thosea asigna virus (Szymczak et al., 2004) was added between the two Zinc Finger Nuclease fusion proteins that were cloned into the construct. Exemplary vectors are described below.

The optimal zinc fingers were verified for cleavage activity using a budding yeast based system previously shown to identify active nucleases. See, e.g., U.S. Patent Publication No. 20090111119; Doyon et al. (2008) Nat. Biotechnol. 26:702-708; Geurts et al. (2009) Science 325:433. Zinc fingers for the various functional domains were selected for in-vivo use. Of the numerous ZFNs that were designed, produced and tested to bind to the putative FAD genomic polynucleotide target sites, a ZFNs were identified as having in vivo activity at high levels, and selected for further experimentation. These ZFNs were characterized as being capable of efficiently binding and cleaving the unique FAD2 genomic polynucleotide target sites in planta.

TABLE 6

FAD3 Zinc Finger Designs

| ZFP | F1 | F2 | F3 | F4 | F5 | F6 |
|---|---|---|---|---|---|---|
| 27961 | RSDNLAR (SEQ ID NO: 178) | QKKDRSY (SEQ ID NO: 179) | RSDNLAR (SEQ ID NO: 180) | QRGNRNT (SEQ ID NO: 181) | RSDHLSR (SEQ ID NO: 182) | RNQDRTN (SEQ ID NO: 183) |

TABLE 6-continued

FAD3 Zinc Finger Designs

| ZFP | F1 | F2 | F3 | F4 | F5 | F6 |
|---|---|---|---|---|---|---|
| 27962 | DRSNLSR (SEQ ID NO: 184) | RQDSRSQ (SEQ ID NO: 185) | QSSDLSR (SEQ ID NO: 186) | DRSALAR (SEQ ID NO: 187) | TSGSLTR (SEQ ID NO: 188) | N/A |
| 27973 | QSSDLSR (SEQ ID NO: 189) | AASNRSK (SEQ ID NO: 190) | TSGSLSR (SEQ ID NO: 191) | RSDALAR (SEQ ID NO: 192) | RSDVLST (SEQ ID NO: 193) | WGRLRKL (SEQ ID NO: 194) |
| 27974 | ERGTLAR (SEQ ID NO: 195) | RSDDLTR (SEQ ID NO: 196) | RSDHLSA (SEQ ID NO: 197) | QHGALQT (SEQ ID NO: 198) | TSGNLTR (SEQ ID NO: 199) | QSGHLSR (SEQ ID NO: 200) |
| 27987 | TSGSLTR (SEQ ID NO: 201) | RSDHLSQ (SEQ ID NO: 202) | CTRNRWR (SEQ ID NO: 203) | RSDNLSE (SEQ ID NO: 204) | ASKTRKN (SEQ ID NO: 205) | N/A |
| 27990 | TSGSLSR (SEQ ID NO: 206) | TSSNRAV (SEQ ID NO: 207) | TSGNLTR (SEQ ID NO: 208) | DRSALAR (SEQ ID NO: 209) | RSDVLSE (SEQ ID NO: 210) | RNFSLTM (SEQ ID NO: 211) |
| 27991 | QSGDLTR (SEQ ID NO: 212) | TSGSLSR (SEQ ID NO: 213) | QSGNLAR (SEQ ID NO: 214) | TSGSLSR (SEQ ID NO: 215) | QSGSLTR (SEQ ID NO: 216) | N/A |
| 27992 | DRSHLAR (SEQ ID NO: 217) | TSGSLSR (SEQ ID NO: 218) | TSSNRAV (SEQ ID NO: 219) | TSGNLTR (SEQ ID NO: 220) | DRSALAR (SEQ ID NO: 221) | N/A |
| 28004 | QSGNLAR (SEQ ID NO: 222) | HLGNLKT (SEQ ID NO: 223) | RSDHLSQ (SEQ ID NO: 224) | TARLLKL (SEQ ID NO: 225) | QSGNLAR (SEQ ID NO: 226) | QTSHLPQ (SEQ ID NO: 227) |
| 28005 | RSDNLSV (SEQ ID NO: 228) | TSGHLSR (SEQ ID NO: 229) | TSGSLTR (SEQ ID NO: 230) | RSDALST (SEQ ID NO: 231) | DRSTRTK (SEQ ID NO: 232) | N/A |
| 28021 | QNAHRKT (SEQ ID NO: 233) | TSGNLTR (SEQ ID NO: 234) | LKQMLAV (SEQ ID NO: 235) | RSDNLSR (SEQ ID NO: 236) | DNSNRKT (SEQ ID NO: 237) | N/A |
| 28022 | RSDNLSV (SEQ ID NO: 238) | QNANRIT (SEQ ID NO: 239) | TSGSLSR (SEQ ID NO: 240) | QSSVRNS (SEQ ID NO: 241) | DRSALAR (SEQ ID NO: 242) | N/A |
| 28023 | RSDNLSR (SEQ ID NO: 243) | DNSNRKT (SEQ ID NO: 244) | DRSNLTR (SEQ ID NO: 245) | RSDVLSE (SEQ ID NO: 246) | TRNGLKY (SEQ ID NO: 247) | N/A |
| 28024 | RSDALAR (SEQ ID NO: 248) | RSDVLSE (SEQ ID NO: 249) | RSSDRTK (SEQ ID NO: 250) | RSDNLSV (SEQ ID NO: 251) | QNANRIT (SEQ ID NO: 252) | N/A |
| 28025 | QSSDLSR (SEQ ID NO: 253) | QSTHRNA (SEQ ID NO: 254) | RSDNLAR (SEQ ID NO: 255) | QRGNRNT (SEQ ID NO: 256) | RSDHLSR (SEQ ID NO: 257) | RNQDRTN (SEQ ID NO: 258) |
| 28026 | DRSNLSR (SEQ ID NO: 259) | RQDSRSQ (SEQ ID NO: 260) | QSSDLSR (SEQ ID NO: 261) | DRSALAR (SEQ ID NO: 262) | TSGSLTR (SEQ ID NO: 263) | N/A |
| 28035 | QSSDLSR (SEQ ID NO: 264) | AASNRSK (SEQ ID NO: 265) | TSGSLSR (SEQ ID NO: 266) | RSDALAR (SEQ ID NO: 267) | RSDTLSQ (SEQ ID NO: 268) | QRDHRIK (SEQ ID NO: 269) |
| 28036 | RSDDLTR (SEQ ID NO: 270) | QSSDLRR (SEQ ID NO: 271) | RSDHLSA (SEQ ID NO: 272) | QHGALQT (SEQ ID NO: 273) | TSGNLTR (SEQ ID NO: 274) | QSGHLSR (SEQ ID NO: 275) |
| 28039 | TSGSLSR (SEQ ID NO: 276) | RSDALAR (SEQ ID NO: 277) | RSDTLSQ (SEQ ID NO: 278) | QRDHRIK (SEQ ID NO: 279) | TSGNLTR (SEQ ID NO: 280) | DRGDLRK (SEQ ID NO: 281) |
| 28040 | DSSDRKK (SEQ ID NO: 282) | TSGNLTR (SEQ ID NO: 283) | DNYNRAK (SEQ ID NO: 284) | DRSHLTR (SEQ ID NO: 285) | RSDNLTT (SEQ ID NO: 286) | N/A |

TABLE 6-continued

FAD3 Zinc Finger Designs

| ZFP | F1 | F2 | F3 | F4 | F5 | F6 |
|---|---|---|---|---|---|---|
| 28051 | RSDNLSN (SEQ ID NO: 287) | TSSSRIN (SEQ ID NO: 288) | RSDNLSE (SEQ ID NO: 289) | ASKTRKN (SEQ ID NO: 290) | RSDALTQ (SEQ ID NO: 291) | N/A |
| 28052 | RSDTLST (SEQ ID NO: 292) | DRSSRIK (SEQ ID NO: 293) | RSDDLSK (SEQ ID NO: 294) | DNSNRIK (SEQ ID NO: 295) | N/A | N/A |
| 28053 | QSSDLSR (SEQ ID NO: 296) | QAGNLSK (SEQ ID NO: 297) | QSGDLTR (SEQ ID NO: 298) | TSGSLSR (SEQ ID NO: 299) | QSGNLAR (SEQ ID NO: 300) | N/A |
| 28054 | TSGSLSR (SEQ ID NO: 301) | LRQTLRD (SEQ ID NO: 302) | TSGNLTR (SEQ ID NO: 303) | DRSALAR (SEQ ID NO: 304) | RSDVLSE (SEQ ID NO: 305) | RNFSLTM (SEQ ID NO: 306) |
| 28055 | QSGDLTR (SEQ ID NO: 307) | TSGSLSR (SEQ ID NO: 308) | QSGNLAR (SEQ ID NO: 309) | TSGSLSR (SEQ ID NO: 310) | QSGSLTR (SEQ ID NO: 311) | N/A |
| 28056 | DRSHLAR (SEQ ID NO: 312) | TSGSLSR (SEQ ID NO: 313) | LRQTLRD (SEQ ID NO: 314) | TSGNLTR (SEQ ID NO: 315) | DRSALAR (SEQ ID NO: 316) | N/A |

TABLE 7

FAD2 Zinc Finger Designs

| ZFP | F1 | F2 | F3 | F4 | F5 | F6 |
|---|---|---|---|---|---|---|
| 24800 | RSDNLST (SEQ ID NO: 317) | HSHARIK (SEQ ID NO: 318) | HRSSLRR (SEQ ID NO: 319) | RSDHLSE (SEQ ID NO: 320) | QNANRIT (SEQ ID NO: 321) | N/A |
| 24801 | DRSNLSR (SEQ ID NO: 322) | HRSSLRR (SEQ ID NO: 323) | TSGNLTR (SEQ ID NO: 324) | MSHHLRD (SEQ ID NO: 325) | DQSNLRA (SEQ ID NO: 326) | N/A |
| 24794 | QSGNLAR (SEQ ID NO: 327) | RSDNLSR (SEQ ID NO: 328) | DNNARIN (SEQ ID NO: 329) | DRSNLSR (SEQ ID NO: 330) | RSDHLTQ (SEQ ID NO: 331) | N/A |
| 24795 | RSDNLRE (SEQ ID NO: 332) | QSGALAR (SEQ ID NO: 333) | QSGNLAR (SEQ ID NO: 334) | RSDVLSE (SEQ ID NO: 335) | SPSSRRT (SEQ ID NO: 336) | N/A |
| 24810 | RSDSLSR (SEQ ID NO: 337) | RKDARIT (SEQ ID NO: 338)** | RSDHLSA (SEQ ID NO: 339)** | WSSSLYY (SEQ ID NO: 340)** | NSRNLRN (SEQ ID NO: 341)** | N/A |
| 24811 | DQSTLRN (SEQ ID NO: 342) | DRSNLSR (SEQ ID NO: 343) | DRSNLWR (SEQ ID NO: 344) | DRSALSR (SEQ ID NO: 345) | RSDALAR (SEQ ID NO: 346) | N/A |
| 24814 | RSDALSR (SEQ ID NO: 347) | DRSDLSR (SEQ ID NO: 348) | RSDHLTQ (SEQ ID NO: 349) | QSGALAR (SEQ ID NO: 350) | QSGNLAR (SEQ ID NO: 351) | N/A |
| 24815 | DRSNLSR (SEQ ID NO: 352) | DSSARNT (SEQ ID NO: 353) | DRSSRKR (SEQ ID NO: 354) | QSGDLTR (SEQ ID NO: 355) | LAHHLVQ (SEQ ID NO: 356) | N/A |
| 24818 | RSDNLST (SEQ ID NO: 357) | HSHARIK (SEQ ID NO: 358) | TSGHLSR (SEQ ID NO: 359) | RSDNLSV (SEQ ID NO: 360) | IRSTLRD (SEQ ID NO: 361) | N/A |
| 24819 | TSGHLSR (SEQ ID NO: 362) | DRSNLSR (SEQ ID NO: 363) | HRSSLRR (SEQ ID NO: 364) | TSGNLTR (SEQ ID NO: 365) | MSHHLRD (SEQ ID NO: 366) | N/A |
| 24796 | RSDALSR (SEQ ID NO: 367) | DRSDLSR (SEQ ID NO: 368) | RSDHLTQ (SEQ ID NO: 369) | QSGALAR (SEQ ID NO: 370) | QSGNLAR (SEQ ID NO: 371) | N/A |

TABLE 7-continued

FAD2 Zinc Finger Designs

| ZFP | F1 | F2 | F3 | F4 | F5 | F6 |
|---|---|---|---|---|---|---|
| 24797 | RSAVLSE (SEQ ID NO: 372) | TNSNRIT (SEQ ID NO: 373) | LKQHLNE (SEQ ID NO: 374) | QSGALAR (SEQ ID NO: 375) | QSGNLAR (SEQ ID NO: 376) | N/A |
| 24836 | DRSNLSR (SEQ ID NO: 377) | QSGDLTR (SEQ ID NO: 378) | QSGALAR (SEQ ID NO: 379) | DRSNLSR (SEQ ID NO: 380) | QRTHLTQ (SEQ ID NO: 381) | N/A |
| 24837 | RSDNLSN (SEQ ID NO: 382) | TNSNRIK (SEQ ID NO: 383) | QSSDLSR (SEQ ID NO: 384) | QSSDLRR (SEQ ID NO: 385) | DRSNRIK (SEQ ID NO: 386) | N/A |
| 24844 | RSANLAR (SEQ ID NO: 387) | RSDNLTT (SEQ ID NO: 388) | QSGELIN (SEQ ID NO: 389) | RSADLSR (SEQ ID NO: 390) | RSDNLSE (SEQ ID NO: 391) | DRSHLAR (SEQ ID NO: 392) |
| 24845 | DRSHLAR (SEQ ID NO: 393) | RSDNLSE (SEQ ID NO: 394) | SKQYLIK (SEQ ID NO: 395) | ERGTLAR (SEQ ID NO: 396) | RSDHLTT (SEQ ID NO: 397) | N/A |
| 24820 | QSGALAR (SEQ ID NO: 398) | QSGNLAR (SEQ ID NO: 399) | DRSHLAR (SEQ ID NO: 400) | DRSDLSR (SEQ ID NO: 401) | RSDNLTR (SEQ ID NO: 402) | N/A |
| 24821 | DRSHLAR (SEQ ID NO: 403) | RSDNLSE (SEQ ID NO: 404) | SKQYLIK (SEQ ID NO: 405) | ERGTLAR (SEQ ID NO: 406) | RSDHLTT (SEQ ID NO: 407) | N/A |
| 24828 | DRSDLSR (SEQ ID NO: 408) | RSDNLTR (SEQ ID NO: 409) | QRTHLTQ (SEQ ID NO: 410) | RSDNLSE (SEQ ID NO: 411) | ASKTRKN (SEQ ID NO: 412) | N/A |
| 24829 | RSDTLSE (SEQ ID NO: 413) | QSHNRTK (SEQ ID NO: 414) | QSDHLTQ (SEQ ID NO: 415) | RSSDLSR (SEQ ID NO: 416) | QSSDLSR (SEQ ID NO: 417) | RSDHLTQ (SEQ ID NO: 418) |
| 24832 | RSDSLSR (SEQ ID NO: 419) | RKDARIT (SEQ ID NO: 420) | DRSHLSR (SEQ ID NO: 421) | QSGNLAR (SEQ ID NO: 422) | QSSDLSR (SEQ ID NO: 423) | DRSALAR (SEQ ID NO: 424) |
| 24833 | RSDDLSK (SEQ ID NO: 425) | RSDTRKT (SEQ ID NO: 426) | DRSNLSR (SEQ ID NO: 427) | DRSNLWR (SEQ ID NO: 428) | RSDSLSR (SEQ ID NO: 429) | NNDHRKT (SEQ ID NO: 430) |

TABLE 8

Target Sites of FAD3 Zinc Fingers

| ZFP | Target Site (5' to 3') | SEQ ID NO: |
|---|---|---|
| 27961 | cgCCGGAGAAAGAGAGAGAGCtttgagg | SEQ ID NO: 36 |
| 27962 | tgGTTGTCGCTATGGACcagcgtagcaa | SEQ ID NO: 37 |
| 27969 | tcTCCGTTcGCATTGcTACGCTggtcca | SEQ ID NO: 38 |
| 27970 | gaAAGGTTtGATCCGAGCGCAcaaccac | SEQ ID NO: 39 |
| 27973 | tcTCCGTTcGCATTGcTACGCTggtcca | SEQ ID NO: 40 |
| 27974 | tcGGAGATATAAGGGCGGCCattcctaa | SEQ ID NO: 41 |
| 27987 | taGCCCAGAACAGGGTTccttgggcggc | SEQ ID NO: 42 |
| 27988 | ctTCGTACTCGGCCACGactggtaattt | SEQ ID NO: 43 |
| 27989 | ttGAAGTTGCAaTAAGCTtttctctcgct | SEQ ID NO: 44 |
| 27990 | acTTGCTGGTCGATCATGTTggccactc | SEQ ID NO: 45 |
| 27991 | aaGTAGTTGAAGTTGCAataagctttct | SEQ ID NO: 46 |
| 27992 | tgGTCGATCATGTTGGCcactcttgttt | SEQ ID NO: 47 |
| 28004 | aaCGAGAATGAAGGAATGAAgaatatga | SEQ ID NO: 48 |
| 28005 | atACCATGGTTGGTAAGtcatttatttt | SEQ ID NO: 49 |
| 28021 | ccAACGAGgAATGATAGAtaaacaagag | SEQ ID NO: 50 |
| 28022 | caGTCACAGTTcTAAAAGtctatggtgt | SEQ ID NO: 51 |
| 28023 | tgTGACTGGAccAACGAGgaatgataga | SEQ ID NO: 52 |
| 28024 | tcTAAAAGTCTATGGTGttccttacatt | SEQ ID NO: 53 |
| 28025 | cgCCGGAGAAAGAGAGAGCTttgaggga | SEQ ID NO: 54 |
| 28026 | tgGTTGTCGCTATGGACcagcgtagcaa | SEQ ID NO: 55 |
| 28035 | ctTAAACGGTGGTTgTGCGCTcggatca | SEQ ID NO: 56 |
| 28036 | tcGGAGATATAAGGGCTGCGattcctaa | SEQ ID NO: 57 |

TABLE 8-continued

Target Sites of FAD3 Zinc Fingers

| ZFP | Target Site (5' to 3') | SEQ ID NO: |
|---|---|---|
| 28039 | tcTCCGATctTAAACGGTGGTTgtgcgc | SEQ ID NO: 58 |
| 28040 | atAAGGGCTGCGATTCCtaagcattgtt | SEQ ID NO: 59 |
| 28051 | agATGGCCCAGAAAAGGgttccttgggc | SEQ ID NO: 60 |
| 28052 | cgTACTCGGCCACGactggtaatttaat | SEQ ID NO: 61 |
| 28053 | ttGAAGTTGCAaTAAGCTttctctcgct | SEQ ID NO: 62 |
| 28054 | acTTGCTGGTCGATCGTGTTggccactc | SEQ ID NO: 63 |
| 28055 | aaGTAGTTGAAGTTGCAataagctttct | SEQ ID NO: 64 |
| 28056 | tgGTCGATCGTGTTGGCcactcttgttt | SEQ ID NO: 65 |

TABLE 9

Target Sites of FAD2 Zinc Fingers

| ZFP | Plasmid No. | Target Site (5' to 3') | ZFP target/binding site present in SEQ ID Nos. |
|---|---|---|---|
| 24800 | pDAB104001 | ccCAAAGGGTTGTTGAGgtacttgccgt | SEQ ID NO: 66 |
| 24801 | pDAB104001 | cgCACCGTGATGTTAACggttcagttca | SEQ ID NO: 67 |
| 24794 | pDAB104002 | taAGGGACGAGGAGGAAggagtggaaga | SEQ ID NO: 68 |
| 24795 | pDAB104002 | ttCTCCTGGAAGTACAGtcatcgacgcc | SEQ ID NO: 69 |
| 24810 | pDAB104003 | gtCGCTGAAGGcGTGGTGgccgcactcg | SEQ ID NO: 70 |
| 24811 | pDAB104003 | caGTGGCTgGACGACACCgtcggcctca | SEQ ID NO: 71 |
| 24814 | pDAB104004 | gaGAAGTAAGGGACGAGgaggaaggagt | SEQ ID NO: 72 |
| 24815 | pDAB104004 | gaAGTACAGTCATCGACgccaccattcc | SEQ ID NO: 73 |
| 24818 | pDAB104005 | tcCCAAAGGGTtGTTGAGgtacttgccg | SEQ ID NO: 74 |
| 24819 | pDAB104005 | acCGTGATGTTAACGGTtcagttcactc | SEQ ID NO: 75 |
| 24796 | pDAB104006 | gaGAAGTAAGGGACGAGgaggaaggagt | SEQ ID NO: 76 |
| 24797 | pDAB104006 | tgGAAGTAcAGTCATCGAcgccaccatt | SEQ ID NO: 77 |
| 24836 | pDAB104007 | gtAGAGACcGTAGCAGACggcgaggatg | SEQ ID NO: 78 |
| 24837 | pDAB104007 | gcTACGCTGCTgTCCAAGgagttgcctc | SEQ ID NO: 79 |
| 24844 | pDAB104008 | gaGGCCAGGCGAAGTAGGAGagagggtg | SEQ ID NO: 80 |
| 24845 | pDAB104008 | acTGGGCCTGCCAGGGCtgcgtcctaac | SEQ ID NO: 81 |
| 24820 | pDAB104009 | gaGAGGCCaGGCGAAGTAggagagaggg | SEQ ID NO: 82 |
| 24821 | pDAB104009 | acTGGGCCTGCCAGGGCtgcgtcctaac | SEQ ID NO: 83 |
| 24828 | pDAB104010 | agGCCCAGtAGAGAGGCCaggcgaagta | SEQ ID NO: 84 |
| 24829 | pDAB104010 | ccAGGGCTGCGTCCTAACCGgcgtctgg | SEQ ID NO: 85 |
| 24832 | pDAB104011 | taGTCGCTGAAGGCGTGGTGgccgcact | SEQ ID NO: 86 |
| 24833 | pDAB104011 | agTGGCTGGACGACaCCGTCGgcctcat | SEQ ID NO: 87 |

Example 3

Evaluation of Zinc Finger Nuclease Cleavage of FAD2 Genes

Construct Assembly

Plasmid vectors containing ZFN expression constructs of the exemplary zinc finger nucleases, which were identified using the yeast assay, as described in Example 2, were designed and completed using skills and techniques commonly known in the art. Each zinc finger-encoding sequence was fused to a sequence encoding an opaque-2 nuclear localization signal (Maddaloni et al. (1989) Nuc. Acids Res. 17(18):7532), that was positioned upstream of the zinc finger nuclease.

Next, the opaque-2 nuclear localization signal::zinc finger nuclease fusion sequence was paired with the complementary opaque-2 nuclear localization signal::zinc finger nuclease fusion sequence. As such, each construct consisted of a single open reading frame comprised of two opaque-2 nuclear localization signal::zinc finger nuclease fusion sequences separated by the 2A sequence from *Thosea asigna* virus (Mattion et al. (1996) *J. Virol.* 70:8124-8127). Expression of the fusion proteins was driven by a relatively strong constitutive promoter such as a promoter derived from the Cassava Vein Mosaic Virus (CsVMV) promoter and flanked by the *Agrobacterium tumefaciens* ORF23 3'UnTranslated Region (AtuORF23 3'UTR).

The vectors were assembled using the IN-FUSION™ Advantage Technology (Clontech, Mountain View, Calif.). Restriction endonucleases were obtained from New England BioLabs (NEB; Ipswich, Mass.) and T4 DNA Ligase (Invitrogen) was used for DNA ligation. Plasmid preparations were performed using NUCLEOSPIN® Plasmid Kit (Macherey-Nagel Inc., Bethlehem, Pa.) or the Plasmid Midi Kit (Qiagen) following the instructions of the suppliers. DNA fragments were isolated using QIAquick Gel Extraction Kit™ (Qiagen) after agarose Tris-acetate gel electrophoresis. Colonies of all assembled plasmids were initially screened by restriction digestion of miniprep DNA. Plasmid DNA of selected clones was sequenced by a commercial sequencing vendor (Eurofins MWG Operon, Huntsville, Ala.). Sequence data were assembled and analyzed using the SEQUENCHER™ software (Gene Codes Corp., Ann Arbor, Mich.). Before delivery to *B. napus* protoplasts, Plasmid DNA was prepared from cultures of *E. coli* using the Pure Yield Plasmid Maxiprep System® (Promega Corporation, Madison, Wis.) or Plasmid Maxi Kit® (Qiagen, Valencia, Calif.) following the instructions of the suppliers.

Figure 5:
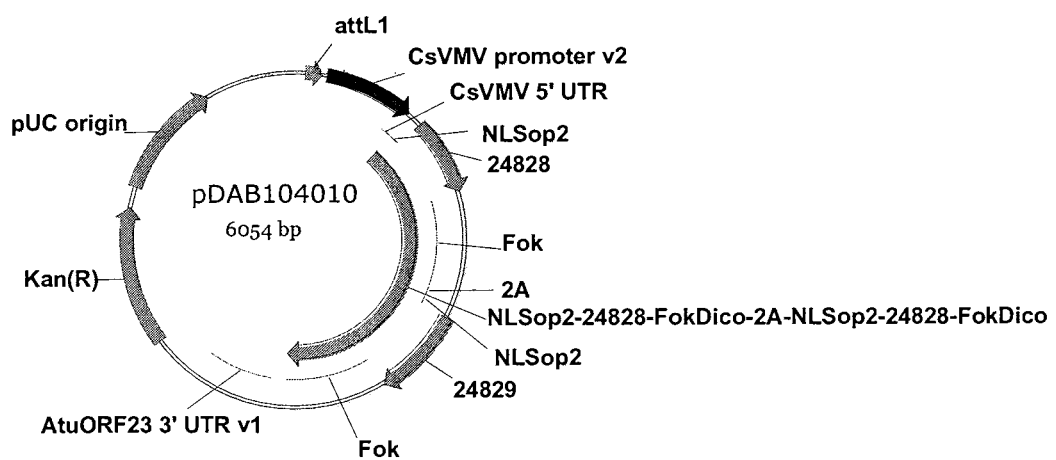
FIG. 5: Shows a plasmid map of pDAB104010 and presents a representative Zinc Finger Nuclease (ZFN) expression cassette. The lay-out of this construct was similar for the other ZFN expression cassettes, wherein the Zinc Finger domains, 24828 and 24829, were exchanged with alternative Zinc Finger domains that are described below.

The resulting eleven plasmid constructs; pDAB104008 (containing the ZFN24845 and ZFN24844 construct), pDAB104009 (containing the ZFN24820 and ZFN24821 construct), pDAB104010 (containing the ZFN24828 and ZFN24829 construct) (FIG. 5), pDAB104003 (containing the ZFN24810 and ZFN24811 construct), pDAB104011 (containing the ZFN24832 and ZFN24833 construct), pDAB104002 (containing the ZFN24794 and ZFN24795 construct), pDAB104006 (containing the ZFN24796 and ZFN24797 construct), pDAB104004 (containing the ZFN24814 and ZFN24815 construct), pDAB104001 (containing the ZFN24800 and ZFN24801 construct), pDAB104005 (containing the ZFN24818 and ZFN24819 construct), and pDAB104007 (containing the ZFN24836 and ZFN24837 construct) were confirmed via restriction enzyme digestion and via DNA sequencing. Table 10 lists the different constructs and the specific FAD sequence which each ZFN was designed to cleave and bind.

The resulting plasmid constructs; pDAB107824 (ZFNs 28025-2A-28026), pDAB107815 (ZFNs 27961-2A-27962), pDAB107816 (ZFNs 27969-2A-27970), pDAB107817 (ZFNs 27973-2A-27974), pDAB107825 (ZFNs 28035-2A-28036), pDAB107826 (ZFNs 28039-2A-28040), pDAB107818 (ZFNs 27987-2A-27988), pDAB107827 (ZFNs 28051-2A-28052), pDAB107821 (ZFNs 28004-2A-28005), pDAB107819 (ZFNs 27989-2A-27990), pDAB107828 (ZFNs 28053-2A-28054), pDAB107829 (ZFNs 28055-2A-28056), pDAB107820 (ZFNs 27991-2A-27992), pDAB107822 (ZFNs 28021-2A-28022) and pDAB107823 (ZFNs 28023-2A-28024) were confirmed via restriction enzyme digestion and via DNA sequencing.

TABLE 10 lists the Zinc Finger protein binding motif and the corresponding construct number. Each Zinc Finger was designed to bind and cleave the FAD2A which is described in the table.

| ZFN Design | Construct No. | Locus ID. | Target Cut Site in FAD2A Sequence |
|---|---|---|---|
| 24844-2A-24845 | pDAB104008 | FAD2_ZFN_Locus1_F2A | 263-265 |
| 24820-2A-24821 | pDAB104009 | FAD2_ZFN_Locus1_F2B | 265 |
| 24828-2A-24829 | pDAB104010 | FAD2_ZFN_Locus1_F2C | 275 |
| 24810-2A-24811 | pDAB104003 | FAD2_ZFN_Locus2_F1D | 343-345 |
| 24832-2A-24833 | pDAB104011 | FAD2_ZFN_Locus2_F1E | 345-346 |
| 24794-2A-24795 | pDAB104002 | FAD2_ZFN_Locus3_F2F | 402 |
| 24796-2A-24797 | pDAB104006 | FAD2_ZFN_Locus3_F2G | 408 |
| 24814-2A-24815 | pDAB104004 | FAD2_ZFN_Locus3_F2H | 408-410 |
| 24800-2A-24801 | pDAB104001 | FAD2_ZFN_Locus4_F1J | 531 |
| 24818-2A-24819 | pDAB104005 | FAD2_ZFN_Locus4_F1K | 532-534 |
| 24836-2A-24837 | pDAB104007 | FAD2_ZFN_Locus5_F1L | 724 |

Preparation of DNA for Transfection

Plasmid DNA of the above described vectors was sterilized by precipitation and washing in 100% (v/v) ethanol and dried in a laminar flow hood. The DNA pellet was suspended in 30 μL of sterile double-distilled water at a final concentration of 0.7 μg/μl for transfection into protoplast cells as described below. The preparation of the plasmid DNA was undertaken to result in supercoiled plasmid DNA for transient transfection and linearized plasmid DNA for stable transfection. The addition of carrier DNA (e.g. fish-sperm DNA) to the transforming plasmid was not required for the transient transfection of protoplast cells. For transient studies about 30 μg of plasmid DNA per $10^6$ protoplasts was used per transformation.

Transfection

Transfection of *Brassica napus* L. var. DH10275 was completed as described in Spangenberg et al., (1986) Plant Physiology 66: 1-8, the media formulations are described in Spangenberg G. and Protrykus I. (1995) Polyethylene Glycol-Mediated Direct Gene Transfer in Tobacco Protoplasts. In: *Gene Transfer to Plants*. (Protrykus I. and Spangenberg G. Eds.) Springer-Verlag, Berlin. *Brassica napus* seeds were surface sterilized in 70% ethanol. The seeds were immersed in 12 mL of the 70% ethanol solution and mixed by gently rocking the cocktail for 10 minutes. The 70% ethanol solution was removed by decanting the solution and exchanged with a seed sterilization solution consisting of 1% w/v calcium hypochlorite and 0.1% v/v Tween-20. The seeds were immersed in the seed sterilization solution and mixed by gently rocking the cocktail for 25 minutes. The seed sterilization solution was decanted and the sterilized seeds were rinsed three times in 50 mL of sterile water. Finally, the seeds were transferred to a sterile 80 mm Whatman filter paper Disc® (Fisher-Scientific, St. Louis, Mo.) that had been laid within a Petri dish and the seeds were lightly saturated with sterile water. The Petri dish was sealed with Parafilm® (Fisher-Scientific, St. Louis, Mo.) and the plates were incubated at 25° C. under complete darkness for one to two days. After signs of seedling emergence were observed from the seeds, the seedlings were transferred to Petri dish containing solidified GEM medium to encourage further seed germination. The seedlings were incubated on the GEM medium at 25° C. for four to five days.

A volume of liquid PS medium (about 10 mL) was decanted into a sterile Petri dish. Using sterile forceps and a scalpel, an aerial portion of the four to five day old seedling in the 4-leaf stage of growth and development, was removed and discarded. Hypocotyl segments in lengths of 20-40 mm were determined to produce the highest population of small, cytoplasmic-rich protoplasts. The hypocotyl segments were aseptically excised and transferred to liquid PS medium. The excised hypocotyl segments were grouped together and cut transversely into 5-10 mm segments. Next, the hypocotyl segments were transferred to fresh PS medium and incubated at room temperature for 1 hour. The plasmolysed hypocotyls were transferred to a Petri dish containing enzyme solution. Care was taken to immerse all of the hypocotyl segments into the solution. The Petri dishes were sealed with Parafilm® and incubated overnight for sixteen to eighteen hours at 20-22° C. with gentle rocking.

Protoplast cells were released from the hypocotyl segments. The overnight hypocotyl digests were gently agitated to release protoplasts into the enzyme solution. The Petri dish was angled slightly to aid the transfer of the digesting suspension which consisted of enzyme solution and plant debris. Using a 10 mL pipette the digesting suspension was transferred to a sterilized protoplast filtration (a filter of 100 micron mesh) unit to further separate the protoplasts from the plant debris. The filtration unit was tapped gently to release the excess liquid that had been caught in the sieve. The protoplast suspension, about 8 to 9 mL, was gently mixed and distributed into 14 mL sterile plastic round-bottomed centrifuge tubes. Each suspension was overlaid with 1.5 mL of W5 solution. The W5 solution was carefully dispensed over the protoplast suspension at an angle and dispensed drop-by-drop with minimal agitation. The addition of the W5 solution to the protoplast suspension resulted in the production of a protoplast rich interface. This interface was collected using a pipette. Next, the collected protoplasts were transferred into a new 14 mL centrifuge tube, and gently mixed. The yield or obtained protoplasts were determined using a haemocytometer to determine the number of protoplasts per milliliter. The method was repeated, wherein leaf tissue was digested to produce mesophyll protoplasts.

Next, W5 solution was added to a volume of 10 mL and the protoplasts were pelleted at 70 g, before removing the W5 solution. The remaining protoplast suspension was resuspended by gentle shaking. Each tube containing the protoplast suspension was filled with 5 mL of W5 solution and incubated at room temperature from one to four hours. The protoplast suspensions were pelleted at 70 g, and all of the W5 solution was removed. Next, 300 µL of transformation buffer was added to each of the pelleted protoplast suspensions which contained the isolated protoplasts. To each of the tubes, 10 µg of plasmid DNA was added to the protoplast suspensions. The plasmid DNA consisted of the Zinc Finger Nuclease constructs described above (e.g., pDAB104010). Next, 300 µL of pre-warmed PEG 4000 solution was added to the protoplast suspension and the tubes were gently tapped. The protoplast suspensions and transformation mixture was allowed to incubate at room temperature for fifteen minutes without any agitation. An additional 10 mL of W5 solution was added to each tube in sequential aliquots of 1 mL, 0.1 mL, 1 mL, 2 mL, 2 mL, and 3 mL with gentle inversion of the tubes between each addition of W5 solution. The protoplasts were pelleted by spinning in a centrifuge at 70 g. All of the W5 solution was removed leaving a pure protoplast suspension.

Next, 0.5 mL of K3 medium was added to the pelleted protoplast cells and the cells were resuspended. The resuspended protoplast cells were placed in the center of a Petri dish and 5 mL of K3 and 0.6 mL Sea Plaque™ agarose (Cambrex, East Rutherford, N.J.) in a 1:1 concentration. The Petri dishes were shaken in a single gentle swirling motion and left to incubate for 20-30 minutes at room temperature. The Petri dishes were sealed with Parafilm® and the protoplasts were cultured for twenty-four hours in complete darkness. After the incubation in darkness, the Petri dishes were cultured for six days in dim light (5 µMol m$^{-2}$ s$^{-1}$ of Osram L36 W/21 Lumilux white tubes). After the culture step, a sterile spatula was used to divide the agarose containing the protoplasts into quadrants. The separated quadrants were placed into a 250 mL plastic culture vessel containing 20 mL of A medium and incubated on a rotary shaker at 80 rpm and 1.25 cm throw at 24° C. in continuous dim light for 14 days and then analyzed to determine the level of activity of each Zinc Finger Nuclease construct.

Genomic DNA Isolation from Canola Protoplasts

Transfected protoplasts were supplied in individual 1.5 or 2.0 mL microfuge tubes. The cells were pelleted at the base of the tube in a buffer solution. DNA extraction was carried out by snap freezing the cells in liquid nitrogen followed by freeze drying the cells, for about 48 hours in a Labconco Freezone 4.5® (Labconco, Kansas City, Mo.) at −40° C. and about 133×10$^{-3}$ mBar pressure. The lyophilized cells were subjected to DNA extraction using the DNeasy® (QIAGEN, Carlsbad, Calif.) plant kit following manufactures instructions, with the exception that tissue disruption was not required and the protoplast cells were added directly to the lysis buffer.

Testing of FAD2A and FAD3 ZFN's for Genomic DNA Sequence Cleavage in Canola Protoplasts The design of the ZFN target sites for the FAD2A and FAD3 gene loci were clustered, so that multiple pairs of ZFN were design to overlap the target sites. The clustering of ZFN target sites enabled PCR primers to be designed that would amplify the surrounding genomic sequence from all FAD2A and FAD3 gene family members within a 100 bp window as to encapsulate all of the overlapping ZFN target sites. As such, the Illumina short read sequence technology could be used to assess the integrity of the target ZFN site of the transfected protoplasts. In addition, the PCR primers designed needed to include specific nucleotide bases that would attribute sequence reads to the specific gene member of the FAD2A and FAD3 family. Therefore, all of the PCR primers would be required to bind 5-10 nucleotides away from any ZFN target cut site as non-homologous end joining (NHEJ) activity is known to cause small deletions that could remove a priming site, inhibit amplification and therefore distort the assessment of NHEJ activity.

Primers were designed to bind to all of the ZFN target loci for the FAD2A and FAD3 gene families (Table 11) and were empirically tested for amplification of all gene family members through Sanger based sequencing of PCR amplification products. In several instances primers could not be developed that would distinguish all gene family members (Table 12 and Table 13), however in all instances the target gene sequences of FAD2A and FAD3, could be distinguished. Following PCR primer design custom DNA barcode sequences were incorporated into the PCR primers that were used to distinguish the different ZFN target loci and identify specific sequence reads to a transfection and ZFN (Tables 11, 12 and 13).

TABLE 11

Primer sequences designed for FAD2 and FAD3 ZFN assessment of activity. Primers include custom barcodes, along with both requisite Illumina adaptor sequences for construction of Illumina library for sequencing-by-synthesis analysis. Purchased primer was the sum of all three columns presented.

| Locus ID | SEQ ID NO: | Illumina Adaptor Primer Sequence Barcode Locus Primer |
|---|---|---|
| FAD2_ZFN_Locus1_F | SEQ ID NO: 88 | ACACTCTTTCCCTACACGACGCTCTTCCGATCT<u>CGGGC</u> CCTCTCYCYTACYTCGCC |
| FAD2_ZFN_Locus1_F2A | SEQ ID NO: 89 | ACACTCTTTCCCTACACGACGCTCTTCCGATCT<u>ACGTA</u> CCCTCTCYCYTACYTCGCC |
| FAD2_ZFN_Locus1_F2B | SEQ ID NO: 90 | ACACTCTTTCCCTACACGACGCTCTTCCGATCT<u>CGTACC</u> CCTCTCYCYTACYTCGCC |
| FAD2_ZFN_Locus1_F2C | SEQ ID NO: 91 | ACACTCTTTCCCTACACGACGCTCTTCCGATCT<u>GTACG</u> CCCTCTCYCYTACYTCGCC |
| FAD2_ZFN_Locus2_F1D | SEQ ID NO: 92 | ACACTCTTTCCCTACACGACGCTCTTCCGATCT<u>TACGTG</u> TCATAGCCCACGAGTGCGGC |
| FAD2_ZFN_Locus2_F1E | SEQ ID NO: 93 | ACACTCTTTCCCTACACGACGCTCTTCCGATCT<u>CTGAC</u> GTCATAGCCCACGAGTGCGGC |
| FAD2_ZFN_Locus3_F2F | SEQ ID NO: 94 | ACACTCTTTCCCTACACGACGCTCTTCCGATCT<u>TGACTG</u> TCGGCCTCATCTTCCACTCC |
| FAD2_ZFN_Locus3_F2G | SEQ ID NO: 95 | ACACTCTTTCCCTACACGACGCTCTTCCGATCT<u>GACTG</u> GTCGGCCTCATCTTCCACTCC |
| FAD2_ZFN_Locus3_F2H | SEQ ID NO: 96 | ACACTCTTTCCCTACACGACGCTCTTCCGATCT<u>ACTGA</u> GTCGGCCTCATCTTCCACTCC |
| FAD2_ZFN_Locus4_F1J | SEQ ID NO: 97 | ACACTCTTTCCCTACACGACGCTCTTCCGATCT<u>GCTAG</u> CAGACATCAAGTGGTACGGC |
| FAD2_ZFN_Locus4_F1K | SEQ ID NO: 98 | ACACTCTTTCCCTACACGACGCTCTTCCGATCT<u>CTAGCC</u> AGACATCAAGTGGTACGGC |
| FAD2_ZFN_Locus5_F1L | SEQ ID NO: 99 | ACACTCTTTCCCTACACGACGCTCTTCCGATCT<u>TAGCTA</u> TCTCCGACGCTGGCATCCTC |
| FAD2_ZFN_Locus1_R1A | SEQ ID NO: 100 | CGGTCTCGGCATTCCTGCTGAACCGCTCTTCCGATCT<u>A CGTA</u>CTGGTAGTCGCTGAAGGCGT |
| FAD2_ZFN_Locus1_R1B | SEQ ID NO: 101 | CGGTCTCGGCATTCCTGCTGAACCGCTCTTCCGATCT<u>C GTAC</u>CTGGTAGTCGCTGAAGGCGT |
| FAD2_ZFN_Locus1_R1C | SEQ ID NO: 102 | CGGTCTCGGCATTCCTGCTGAACCGCTCTTCCGATCT<u>G TACG</u>CTGGTAGTCGCTGAAGGCGT |
| FAD2_ZFN_Locus2_R1D | SEQ ID NO: 103 | CGGTCTCGGCATTCCTGCTGAACCGCTCTTCCGATCT<u>T ACGT</u>GGACGAGGAGGAAGGAGTGGA |
| FAD2_ZFN_Locus2_R1E | SEQ ID NO: 104 | CGGTCTCGGCATTCCTGCTGAACCGCTCTTCCGATCT<u>CT GAC</u>GGACGAGGAGGAAGGAGTGGA |
| FAD2_ZFN_Locus3_R1F | SEQ ID NO: 105 | CGGTCTCGGCATTCCTGCTGAACCGCTCTTCCGATCT<u>T GACT</u>AGTGTTGGAATGGTGGCGTCG |
| FAD2_ZFN_Locus3_R1G | SEQ ID NO: 106 | CGGTCTCGGCATTCCTGCTGAACCGCTCTTCCGATCT<u>G ACTG</u>AGTGTTGGAATGGTGGCGTCG |
| FAD2_ZFN_Locus3_R1H | SEQ ID NO: 107 | CGGTCTCGGCATTCCTGCTGAACCGCTCTTCCGATCT<u>A CTGA</u>AGTGTTGGAATGGTGGCGTCG |

TABLE 11-continued

Primer sequences designed for FAD2 and FAD3 ZFN assessment of activity. Primers include custom barcodes, along with both requisite Illumina adaptor sequences for construction of Illumina library for sequencing-by-synthesis analysis. Purchased primer was the sum of all three columns presented.

| Locus ID | SEQ ID NO: | Illumina Adaptor Primer Sequence Barcode Locus Primer |
|---|---|---|
| FAD2_ZFN_Locus4_R1J | SEQ ID NO: 108 | CGGTCTCGGCATTCCTGCTGAACCGCTCTTCCGATCTG CTAGCCCGAGACGTTGAAGGCTAAG |
| FAD2_ZFN_Locus4_R1K | SEQ ID NO: 109 | CGGTCTCGGCATTCCTGCTGAACCGCTCTTCCGATCTCT AGCCCCGAGACGTTGAAGGCTAAG |
| FAD2_ZFN_Locus5_R1L | SEQ ID NO: 110 | CGGTCTCGGCATTCCTGCTGAACCGCTCTTCCGATCTT AGCTGAAGGATGCGTGTGCTGCAAG |
| FAD3_ZFN_Locus1 A_F3 | 111 | ACACTCTTTCCCTACACGACGCTCTTCCGATCT ACGTA CCTTTCTTCACCACATTYCA |
| FAD3_ZFN_Locus1 B_F3 | 112 | ACACTCTTTCCCTACACGACGCTCTTCCGATCT CGTAC CCTTTCTTCACCACATTYCA |
| FAD3_ZFN_Locus2 C_F1 | 113 | ACACTCTTTCCCTACACGACGCTCTTCCGATCTCTGACG ATGGTTGTCGCTATGGACC |
| FAD3_ZFN_Locus3 D_F1 | 114 | ACACTCTTTCCCTACACGACGCTCTTCCGATCTTGACTC GAAAGGTTTGATCCRAGCG |
| FAD3_ZFN_Locus3E _F1 | 115 | ACACTCTTTCCCTACACGACGCTCTTCCGATCTGACTGC GAAAGGTTTGATCCRAGCG |
| FAD3_ZFN_Locus3F _F1 | 116 | ACACTCTTTCCCTACACGACGCTCTTCCGATCTACTGAC GAAAGGTTTGATCCRAGCG |
| FAD3_ZFN_Locus4 G_F1 | 117 | ACACTCTTTCCCTACACGACGCTCTTCCGATCTGCTAGC CGTGTATTTTGATAGCTGGTTC |
| FAD3_ZFN_Locus4 H_F1 | 118 | ACACTCTTTCCCTACACGACGCTCTTCCGATCTCTAGCC CGTGTATTTTGATAGCTGGTTC |
| FAD3_ZFN_Locus5J _F1 | 119 | ACACTCTTTCCCTACACGACGCTCTTCCGATCTTAGCTG GAGCTTCTCAGACATTCCTCT |
| FAD3_ZFN_Locus6 K_F1 | 120 | ACACTCTTTCCCTACACGACGCTCTTCCGATCTTCAGTG TTTATTTGCCCCAAGCGAGAG |
| FAD3_ZFN_Locus6L _F1 | 121 | ACACTCTTTCCCTACACGACGCTCTTCCGATCTCAGTCG TTTATTTGCCCCAAGCGAGAG |
| FAD3_ZFN_Locus6 M_F1 | 122 | ACACTCTTTCCCTACACGACGCTCTTCCGATCTAGTCAG TTTATTTGCCCCAAGCGAGAG |
| FAD3_ZFN_Locus6 N_F1 | 123 | ACACTCTTTCCCTACACGACGCTCTTCCGATCTGTCAGG TTTATTTGCCCCAAGCGAGAG |
| FAD3_ZFN_Locus7P _F3 | 124 | ACACTCTTTCCCTACACGACGCTCTTCCGATCTGTACGA CTTCAACTACTTGCTGGTCSAT |
| FAD3_ZFN_Locus7 Q_F3 | 125 | ACACTCTTTCCCTACACGACGCTCTTCCGATCTTACGTA CTTCAACTACTTGCTGGTCSAT |
| FAD3_ZFN_Locus1 A_R1 | 126 | CGGTCTCGGCATTCCTGCTGAACCGCTCTTCCGATCTAC GTACGTTCACATTGSTRCGYTGG |
| FAD3_ZFN_Locus1 B_R1 | 127 | CGGTCTCGGCATTCCTGCTGAACCGCTCTTCCGATCTC GTACCGTTCACATTGSTRCGYTGG |
| FAD3_ZFN_Locus2 C_R1 | 128 | CGGTCTCGGCATTCCTGCTGAACCGCTCTTCCGATCTCT GACCCGATCTTAAACGGYGGTTGT |
| FAD3_ZFN_Locus3 D_R1 | 129 | CGGTCTCGGCATTCCTGCTGAACCGCTCTTCCGATCTTG ACTTAGCTCATGGATCTCAAAGGACT |
| FAD3_ZFN_Locus3E _R1 | 130 | CGGTCTCGGCATTCCTGCTGAACCGCTCTTCCGATCTG ACTGTAGCTCATGGATCTCAAAGGACT |
| FAD3_ZFN_Locus3F _R1 | 131 | CGGTCTCGGCATTCCTGCTGAACCGCTCTTCCGATCTAC TGATAGCTCATGGATCTCAAAGGACT |

TABLE 11-continued

Primer sequences designed for FAD2 and FAD3 ZFN assessment of activity. Primers include custom barcodes, along with both requisite Illumina adaptor sequences for construction of Illumina library for sequencing-by-synthesis analysis. Purchased primer was the sum of all three columns presented.

| Locus ID | SEQ ID NO: | Illumina Adaptor Primer Sequence Barcode Locus Primer |
|---|---|---|
| FAD3_ZFN_Locus4 G_R_uni | 132 | CGGTCTCGGCATTCCTGCTGAACCGCTCTTCCGATCTG CTAGTTAAATTACCAGTCGTGGCC |
| FAD3_ZFN_Locus4 H_R_uni | 133 | CGGTCTCGGCATTCCTGCTGAACCGCTCTTCCGATCTCT AGCTTAAATTACCAGTCGTGGCC |
| FAD3_ZFN_Locus5J_R2 | 134 | CGGTCTCGGCATTCCTGCTGAACCGCTCTTCCGATCTTA GCTCTTTTTTCTTCGATKCTAAAGATT |
| FAD3_ZFN_Locus6 K_R1 | 135 | CGGTCTCGGCATTCCTGCTGAACCGCTCTTCCGATCTTC AGTCTGTGACTGGACCAACGAGG |
| FAD3_ZFN_Locus6L_R1 | 136 | CGGTCTCGGCATTCCTGCTGAACCGCTCTTCCGATCTCA GTCCTGTGACTGGACCAACGAGG |
| FAD3_ZFN_Locus6 M_R1 | 137 | CGGTCTCGGCATTCCTGCTGAACCGCTCTTCCGATCTA GTCACTGTGACTGGACCAACGAGG |
| FAD3_ZFN_Locus6 N_R1 | 138 | CGGTCTCGGCATTCCTGCTGAACCGCTCTTCCGATCTGT CAGCTGTGACTGGACCAACGAGG |
| FAD3_ZFN_Locus7P_R1 | 139 | CGGTCTCGGCATTCCTGCTGAACCGCTCTTCCGATCTGT ACGACTTACAATGTAAGGAACRCCRTA |
| FAD3_ZFN_Locus7 Q_R1 | 140 | CGGTCTCGGCATTCCTGCTGAACCGCTCTTCCGATCTTA CGTACTTACAATGTAAGGAACRCCRTA |

TABLE 12

Amplification performance of the designed PCR primers on the FAD2 gene families. An "X" indicates gene copy detection specificity and a "+" indicates that at the specific locus in question the sequence reads designed by the two primers were unable to be distinguished and an "N/A" indicates that the locus was unable to be amplified from those specific gene copies.

| ZFN Locus | FAD Gene Copy | | | |
|---|---|---|---|---|
| | FAD2A | FAD2C | FAD2A' | FAD2C' |
| Locus 1 | X | X | X | X |
| Locus 2 | X | X | X | X |
| Locus 3 | + | + | X | X |
| Locus 4 | X | X | X | X |
| Locus 5 | X | X | X | X |

TABLE 13

Amplification performance of the designed PCR primers on the FAD3 gene families. An "X" indicates gene copy detection specificity and a "+" indicates that at the specific locus in question the sequence reads designed by the two primers were unable to be distinguished and an "N/A" indicates that the locus was unable to be amplified from those specific gene copies.

| ZFN Locus | FAD Gene Copy | | | | | |
|---|---|---|---|---|---|---|
| | FAD3A | FAD3C | FAD3A' | FAD3C' | FAD3A" | FAD3C" |
| Locus 1 | X | X | X | X | X | X |
| Locus 2 | X | X | X | X | N/A | X |
| Locus 3 | X | X | + | + | X | X |
| Locus 4 | X | X | X | X | + | + |
| Locus 5 | X | X | N/A | N/A | N/A | N/A |
| Locus 6 | X | X | X | X | X | X |
| Locus 7 | X | X | X | X | X | X |

Following DNA extraction of canola protoplasts transfected with the ZFN, PCR amplification of the target ZFN loci was performed to generate the requisite loci specific DNA molecules in the correct format for Illumina based sequencing by synthesis technology. Each assay was optimised to work on 25 ng starting DNA (about 12,500 cell equivalents of the *Brassica napus* genome). Multiple reactions were performed, per sample to provide the coverage required to assess NHEJ efficiency and specificity at the appropriate level, about sixteen PCR reactions equivalent to 200,000 copies of the *Brassica napus* genome taken from individual protoplasts. PCR amplification master-mixes were made for all samples to be tested with the same assay and one reaction, performed in triplicate, was assayed using a quantitative PCR method that was used to determine the optimal number of cycles to perform on the target tissue, to ensure that PCR amplification had not become reagent limited and was still in an exponential amplification stage. The experimentation with the necessary negative control reactions, was performed in 96 well format using a MX3000P Thermocycler® (Stratagene, LaJolla, Calif.). From the output gathered from the quantitative PCR platform, the relative increase in fluorescence was plotted from cycle-to-cycle and the cycle number was determined per assay that would deliver sufficient amplification, while not allowing the reaction to become reagent limited, in an attempt to reduce over cycling and the amplification of common transcripts or molecules. The unused master mix, remained on ice until the quantitative PCR analysis was concluded and the cycle number determined and was then aliquoted into the desired number of reaction tubes (about 16 per ZFN assay) and the PCR reaction was performed. Following amplification, samples for a single ZFN locus were pooled together and 200 µL of pooled product per ZFN was cleaned using the MinElute PCR purification Kit® (Qiagen) following manufacturer's instructions. To enable the sample to be sequenced using the Illumina short read technology additional paired end primers were required to be attached by amplification onto the generated fragments. This was achieved by PCR amplification using primers that would be, in part complementary to the sequence added in the first round of amplification, but also contain the paired end sequence required. The optimal number of PCR cycles to perform, that would add the paired end sequences without over amplifying common fragments to the template was again determined using a sample pass through a quantitative PCR cycle analysis, as described previously. Following PCR amplification, the generated product was cleaned using a MinElute Column® (Qiagen) following manufacturer's instructions and was resolved on a 2.5% agarose gel. DNA fragments visualised using Syber® Safe (Life Technologies, Carlsbad, Calif.) as bands of the correct size were gel extracted to remove any residual PCR generated primer-dimer or other spurious fragments, the DNA was extracted from the gel slice using a MinElute gel extraction Kit® (Qiagen) following manufacturer's instructions. After completion of the gel extraction an additional clean up of the DNA was performed using AMPure magnetic Beads® (Beckman-Coulter, Brea, Calif.) with a DNA to bead ratio of 1:1.7. The DNA was then assessed for concentration using a quantitative PCR based library quantification kit for Illumina sequencing (KAPA) with a 1/40,000 and a 1/80,000 dilution and with the reaction being performed in triplicate. Based on the quantitative PCR results the DNA was diluted to a standard concentration of 2 nM and all libraries were combined for DNA sequencing. The samples were prepared for sequencing using a cBot cluster generation Kit® (Illumina, San Diego, Calif.) and were sequenced on an Illumina GA2x® with 100 bp paired-end sequencing reads following manufacturer's instructions.

Method of Data Analysis for Detection of Non-Homologous End Joining at Target Zinc Finger Sites Following completion of the sequencing reaction and primary data calling performed using the Illumina bioinformatic pipeline for base calling, full analysis was performed to identify deleted bases at the target ZFN site in each instance. A custom PERL script was designed to extract and sort barcodes from DNA sequences computationally following a list of input sequences. The barcode had to match the reference sequence at a Phred score of greater than 30 to be accepted, to reduce misattributing sequence reads. After the sequence reads had been binned into the different barcode groups that had been used; a quality filter was passed across all sequences. The quality filter was a second custom developed PERL script. Sequence reads were excluded if there were more than three bases called as "N", or if the median Phred score was less than 20, or if there were 3 consecutive bases with a Phred score of less than 20, or if the sequence read was shorter than 40 bp in length. The remaining sequences were merged where both of the paired sequence reads were available using the NextGENe® (SoftGenetics, State College, Pa.) package. The remaining merged sequence reads were then reduced to a collection of unique sequence reads using a third custom PERL script with a count of the number of redundant sequences that had been identified recorded on the end of the remaining sequence identifier. The unique sequence reads were then aligned to the FAD2 and FAD3 reference sequence using the NextGENe® software that created a gapped FASTA aligned file.

Using the gapped FASTA file a conversion of the gapped base position number to the input reference was performed using a fourth custom PERL script. This enabled bases that discriminate the different gene family members (either homoeologous or paralogous sequence variation between the different gene family members) to be identified in the assembled data. Once the conversion of base numbering had been performed it was possible to generate haplotype reports for each unique sequence reads and assign the reads to specific gene family members. Once the reads had been grouped by gene a 10 bp window was identified and assessed that surrounded the ZFN target site. The number of sequences with deletions was recorded per gene along with the number of missing bases.

Figure 6:
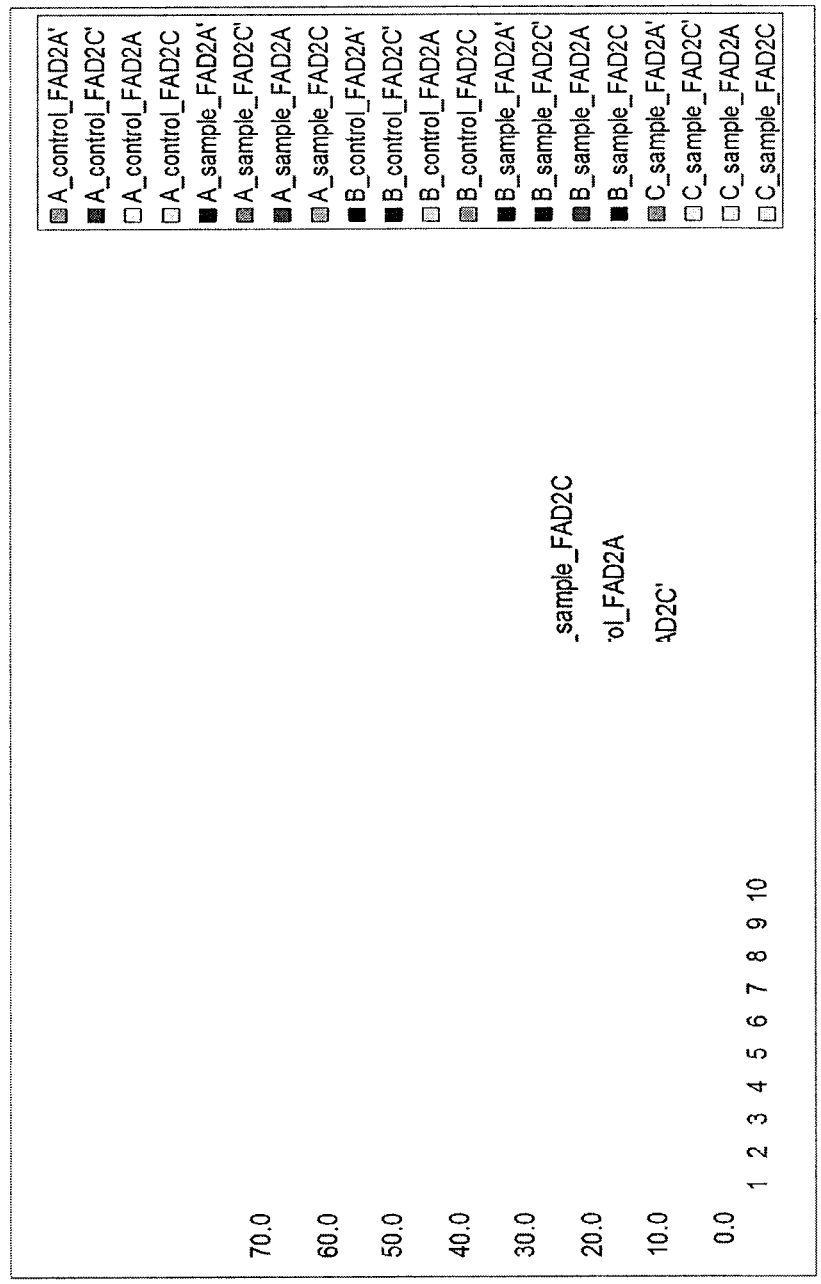
FIG. 6: is an example multiple line graph showing number of sequence reads per 10,000 sequence reads with deletions at the target ZFN site. The X axis on the graph denotes number of bases deleted, the Y axis denotes number of sequence reads and the Z axis denotes colour-coded sample identity as described to the right of the graph. Specific example shown is for locus 1 of the FAD2 gene family that contains 3 target ZFN sites, A, B and C with the four gene family members and two control transfections assessed as control samples A and B. The lines listed from top to bottom (A-control_FADA' at the top of the legend to C_sample_FAD2C at the bottom of the legend) are shown on the graph from closest to the labeled X-axis (A_control_FADA') to farthest from the labeled X-axis (C_sample_FAD2C).
Figure 7A:
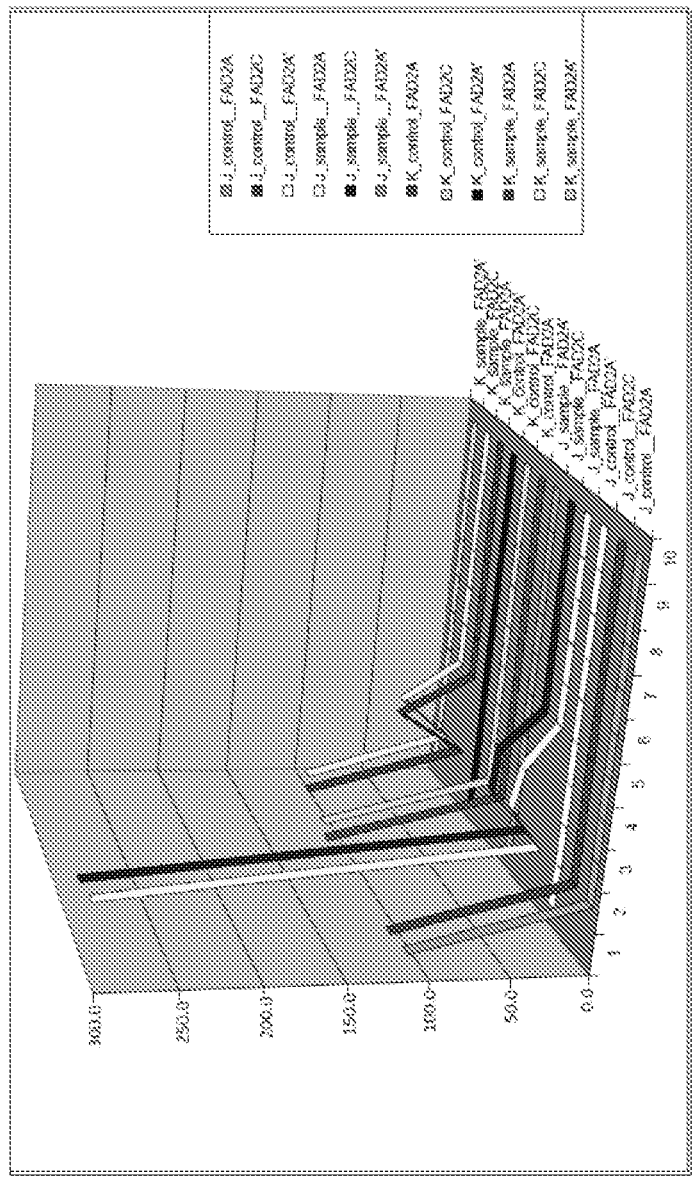
FIG. 7: (A) The figure displays data from ZFN targeting locus 4 of the FAD2 gene family. The locus contains two ZFN sites and two requisite control transfections.
Figure 7B:
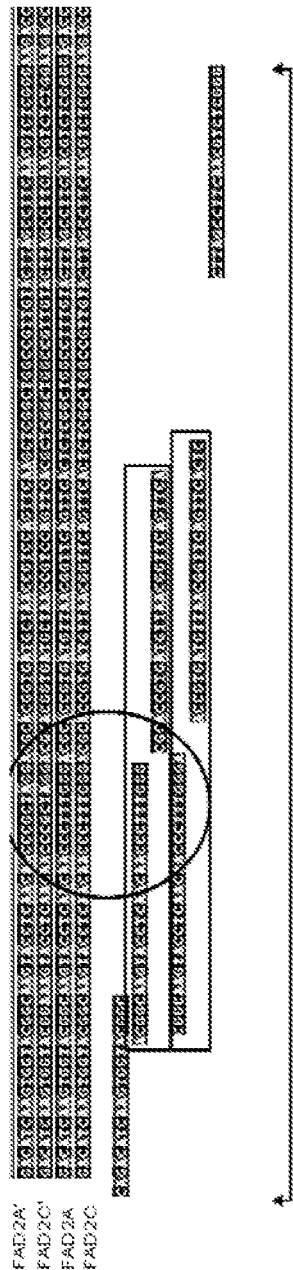

The data was then graphically displayed as a multiple line graph, with the number of sequences with 1 through 10 bases deleted at the target ZFN site per 10,000 sequence reads (FIG. 6). This analysis was performed for all ZFN transfections along with control transfections. In several instances, repeats in the native DNA sequence lead to an increase in sequencing error in the target ZFN site, such an error can be commonly seen as an increase in the prevalence of single base deletions that were reported in all samples, both transfected with ZFN or controls (FIG. 7).

From these results highest level of ZFN activity at a FAD2 target site, as determined by the greater activity of NHEJ, was identified at locus E. The ZFNs which were encoded on plasmid pDAB104010 (i.e., ZFN24828 and 24829) were selected for in planta targeting of an Engineered Transgene Integration Platform (ETIP) given its characteristics of significant genomic DNA cleavage activity and minimal non-target activity.

Example 4

DNA Constructs for Engineered Transgene Integration Platform (ETIP) Canola Plant Lines The plasmid vector constructs described below were built using methods and techniques commonly known by one with skill in the art. The application of specific reagents and techniques described within this paragraph are readily known by those with skill in the art, and could be readily interchanged with other reagents and techniques to achieve the desired purpose of building plasmid vector constructs. The restriction endonucleases were obtained from New England BioLabs (NEB; Ipswich, Mass.). Ligations were completed with T4 DNA Ligase (Invitrogen, Carlsbad, Calif.). Gateway reactions were performed using GATEWAY® LR CLONASE® enzyme mix (Invitrogen) for assembling one entry vector into a single destination vector. IN-FUSION™ reactions were performed using IN-FUSION™ Advantage Technology (Clontech, Mountain View, Calif.) for assembling one entry vector into a single destination vector Plasmid preparations were performed using NUCLEOSPIN® Plasmid Kit (Macherey-Nagel Inc., Bethlehem, Pa.) or the Plasmid Midi Kit® (Qiagen) following the instructions of the suppliers. DNA fragments were isolated using QIAquick Gel Extraction Kit™ (Qiagen) after agarose Tris-acetate gel electrophoresis. Colonies of all assembled plasmids were initially screened by restriction digestion of miniprep DNA. Plasmid DNA of selected clones was sequenced by a commercial sequencing vendor (Eurofins MWG Operon, Huntsville, Ala.). Sequence data were assembled and analyzed using the SEQUENCHER™ software (Gene Codes Corp., Ann Arbor, Mich.).

Figure 8:
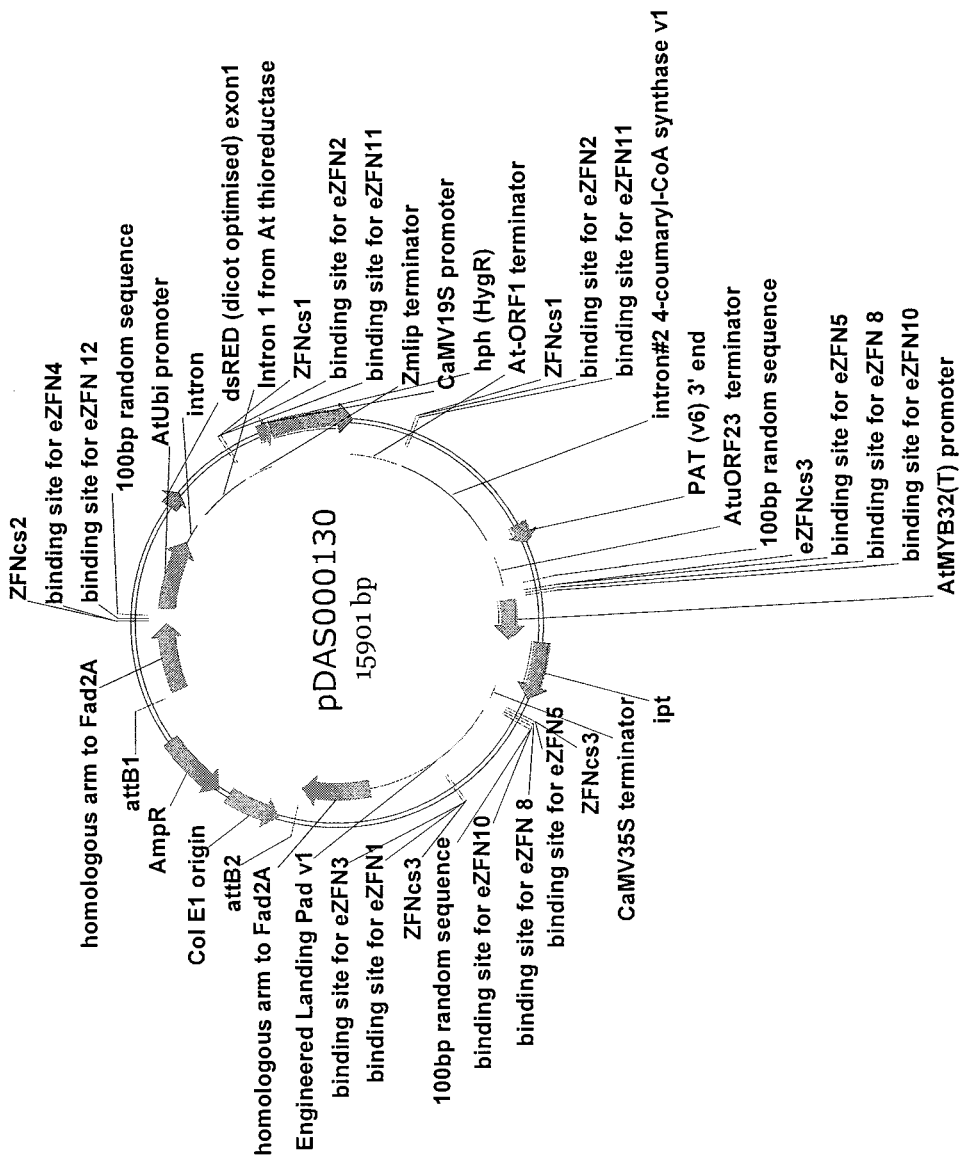
FIG. 8: Shows a plasmid map of pDAS000130.

Direct-Delivery Vectors for Precision Integration of ETIP in the FAD2A Locus of Canola Standard cloning methods were used in the construction of the ETIP-containing vectors pDAS000130 (FIG. 8, T-strand insert as SEQ ID NO:141), for specific integration into the FAD2A gene of *B. napus*. This construct has been designed to be delivered into canola protoplasts with the Zinc Finger Nuclease construct pDAB1004010. The Zinc Finger Nuclease Construct will cleave the FAD2A locus and then the pDAS000130 construct will integrate within the canola genome via a homology directed repair mechanism, and can be modified by removing the homology flanking regions for NHEJ mediated integration. The ETIP consists of four expression cassettes (two incomplete) separated by additional ZFN recognition sequences and an Engineered Landing Pad (ELP) containing another ZFN recognition sequences. The additional ZFN recognition sequences are unique and have been designed to be targeted for the introduction of polynucleotide sequences within the ETIP and ELP transgene insertions. Similarly, the ZFN recognition sequences can be utilized for excision of polynucleotide sequences. The first gene expression cassette was an incomplete dsRED expression cassette and contained the promoter, 5' untranslated region and intron from the *Arabidopsis thaliana* Polyubiquitin 10 (AtUbi promoter) gene (Callis, et al., (1990) *J. Biol. Chem.*, 265: 12486-12493) followed by 210 bp of a dsRed gene from the reef coral *Discosoma* sp. (Clontech, Mountain View, Calif.) codon-optimised for expression in dicot plants (ds RED (dicot optimized)exon 1) followed by an intron from the *Arabidopsis thaliana* thioreductase-like gene (Intron 1 from At thioreductase: Accession No: NC_00374) and the 3' untranslated region comprising the transcriptional terminator and polyadenylation site of the *Zea mays* Viviparous-1 (Vp1) gene (Zmlip terminator: Paek et al., (1998) Molecules and Cells, 8(3): 336-342). The second expression cassette contained the 19S promoter including 5' UTR from cauliflower mosaic virus (CaMV 19S: Cook and Penon (1990) *Plant Molecular Biology* 14(3): 391-405) followed by the hph gene from *E. coli*, codon-optimised for expression in dicots (hph(HygR): Kaster et al., (1983) Nucleic Acids Research 11(19): 6895-6911) and the 3'UTR comprising the transcriptional terminator and polyadenylation site of open reading frame 1 of *A. tumefaciens* pTi15955 (At-ORF1 terminator: Barker et al., (1983) Plant Molecular Biology 2(6): 335-50). The third expression cassette was an incomplete PAT expression cassette and contained the first intron from *Arabidopsis* 4-coumaryl-CoA synthase (intron #2 4-coumaryl-CoA synthase v: Accession No: At3g21320/NC003074) followed by the last 256 bp of a synthetic, plant-optimized version of phosphinothricin acetyl transferase gene, isolated from *Streptomyces viridochromogenes*, which encodes a protein that confers resistance to inhibitors of glutamine synthetase comprising phosphinothricin, glufosinate, and bialaphos (PAT(v6) 3' end: Wohlleben et al., (1988) Gene 70(1): 25-37). This cassette was terminated with the 3' UTR comprising the transcriptional terminator and polyadenylation sites of open reading frame 23 of *A. tumefaciens* pTi15955 (AtuORF23 terminator: Barker et al., (1983) Plant Molecular Biology 2(6): 335-50). The fourth Expression Cassette was the ipt gene cassette and contained a 588 bp truncated version of the promoter and 5' UTR from the *Arabidopsis* DNA-binding protein MYB32 gene (U26933) (AtMYB32(T) promoter: Li et al., (1999) Plant Physiology 121: 313) followed by the isopentyl transferase (ipt) gene from *A. tumefaciens* and the 35s terminator comprising the transcriptional terminator and polyadenylation sites from cauliflower mosaic virus (CaMV 35S terminator: Chenault et al., (1993) Plant Physiology 101 (4): 1395-1396). For delivery to FAD2A, each end of the ETIP sequence was flanked by 1 kb of FAD2A genomic sequence from either side of the location of the double-stranded break induced by delivery of the ZFN encoded in pDAB104010 to the FAD2A gene of *B. napus*.

The ETIP sequence was synthesized by a commercial gene synthesis vendor (GeneArt, Life Technologies). The 1 kb segments of FAD2A genome sequence were amplified from genomic DNA purified from leaf tissue of *B. napus* DH12075 using a Qiagen DNeasy plant mini Kit® (Qiagen, Hilden) following instructions supplied by the manufacturer. The 1 kb FAD2A sequences were ligated into the ETIP vector using T4 ligase (NEB, Ipswich, Mass.). Colonies of all assembled plasmids were initially screened by restriction digestion of miniprep DNA. Restriction endonucleases were obtained from New England BioLabs (NEB, Ipswich, Mass.) and Promega (Promega Corporation, WI). Plasmid preparations were performed using the QIAprep Spin Miniprep Kit® (Qiagen) or the Pure Yield Plasmid Maxiprep System® (Promega Corporation, WI) following the instructions of the suppliers. Plasmid DNA of selected clones was sequenced using ABI Sanger Sequencing and Big Dye Terminator v3.1 cycle sequencing Protocol® (Applied Biosystems, Life Technologies). Sequence data were assembled and analyzed using the SEQUENCHER™ software (Gene Codes Corp., Ann Arbor, Mich.).

Figure 9:
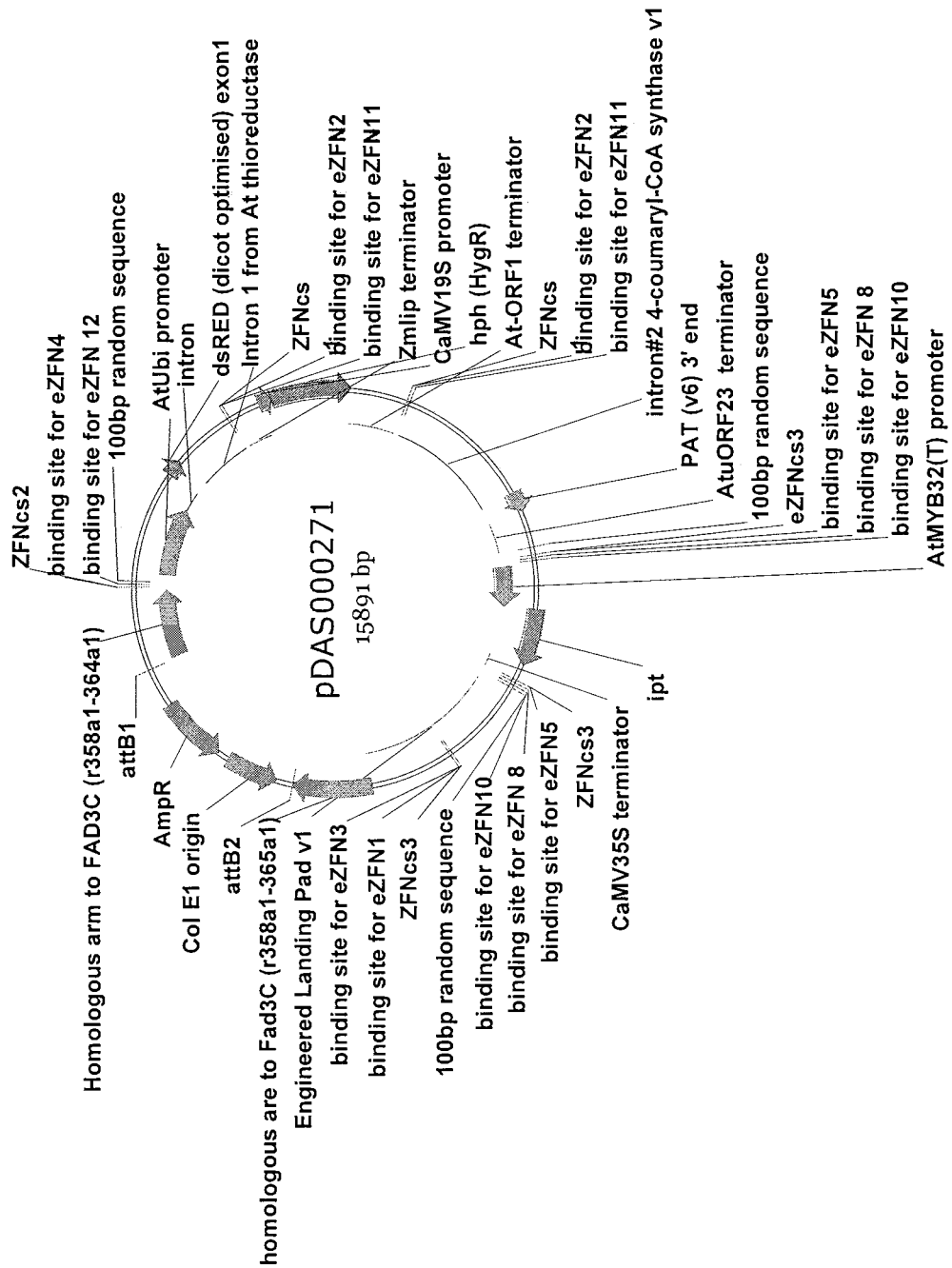
FIG. 9: Shows a plasmid map of pDAS000271.
Figure 10:
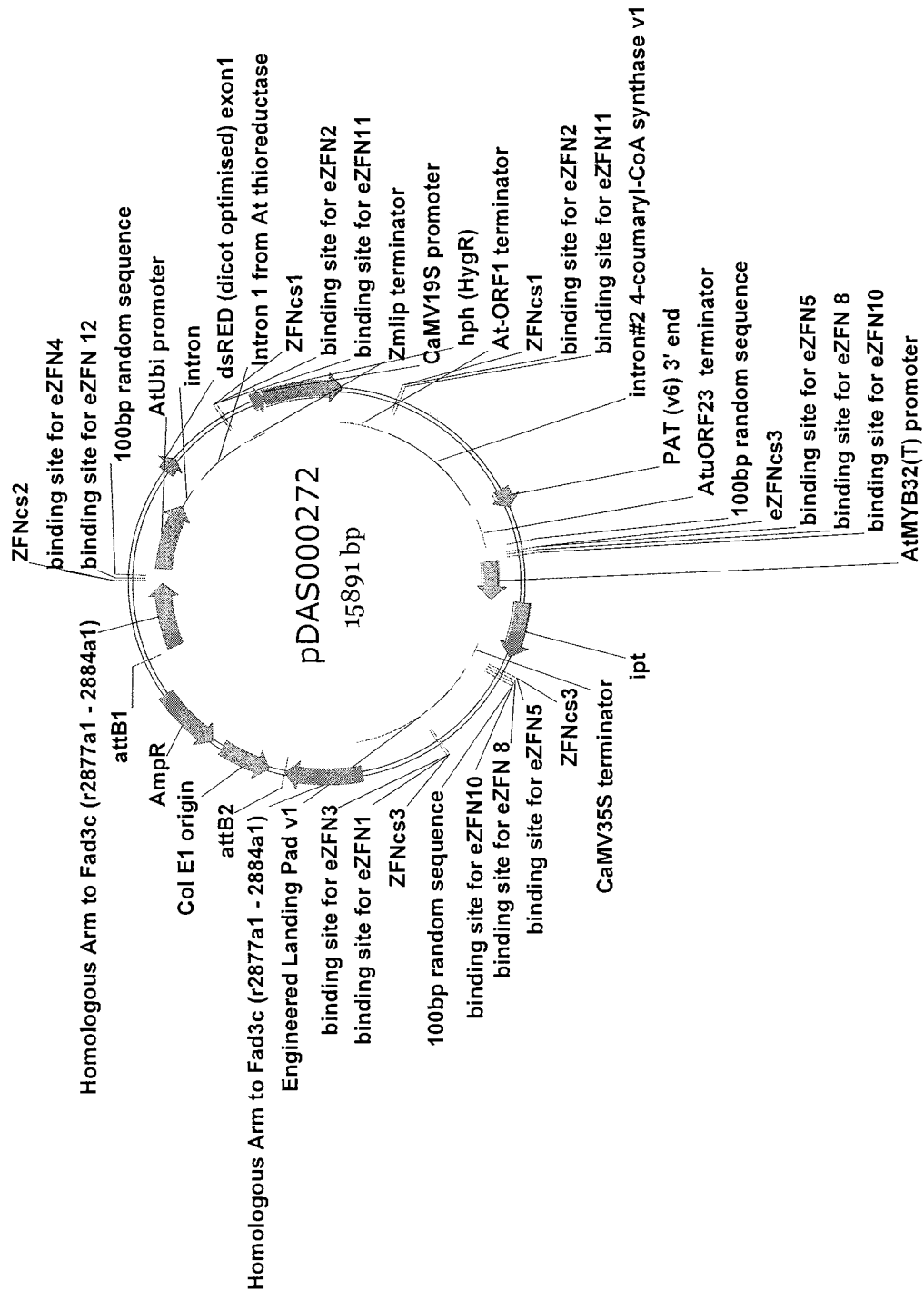
FIG. 10: Shows a plasmid map of pDAS000272.
Figure 11:
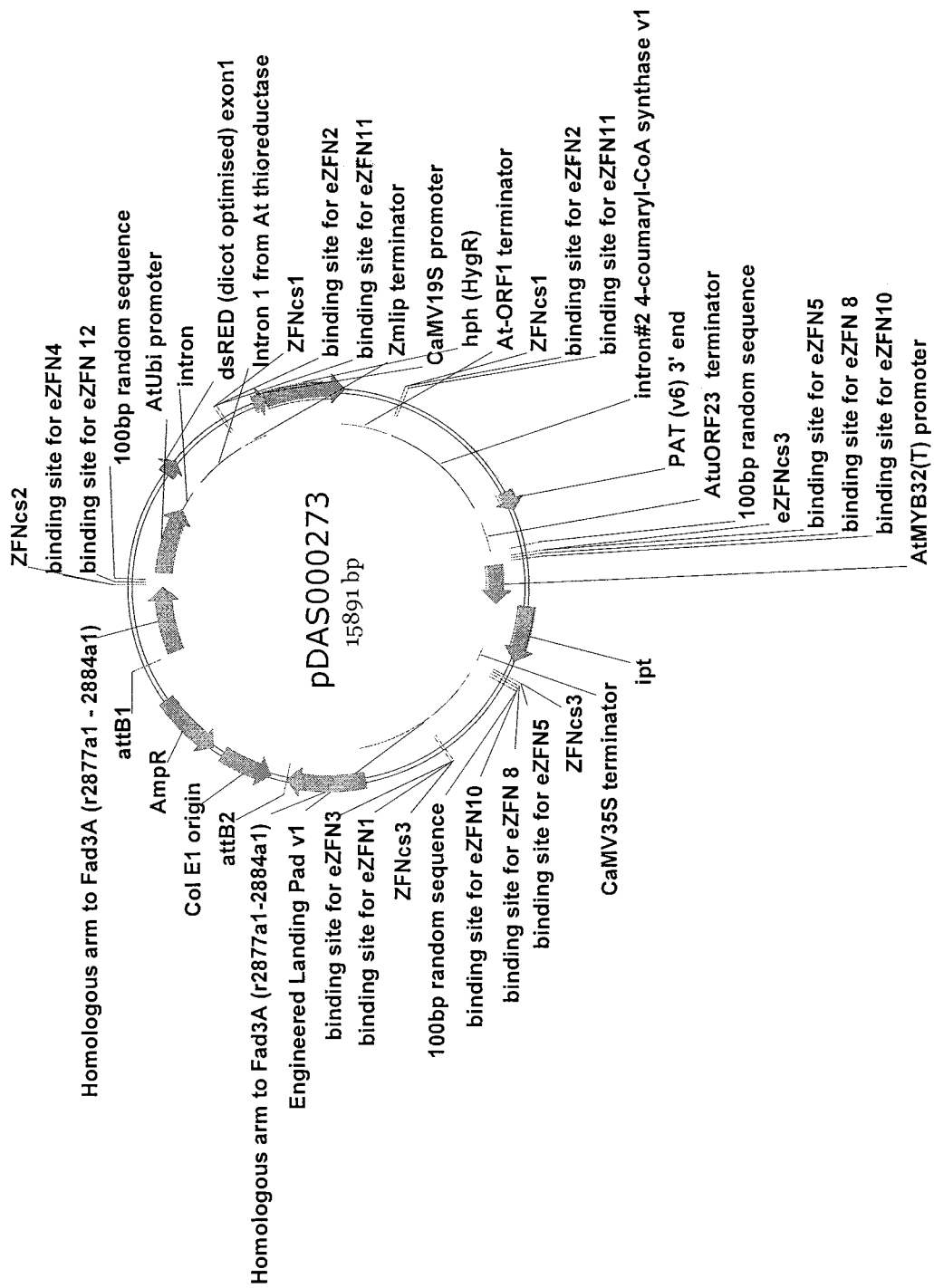
FIG. 11: Shows a plasmid map of pDAS000273.
Figure 12:
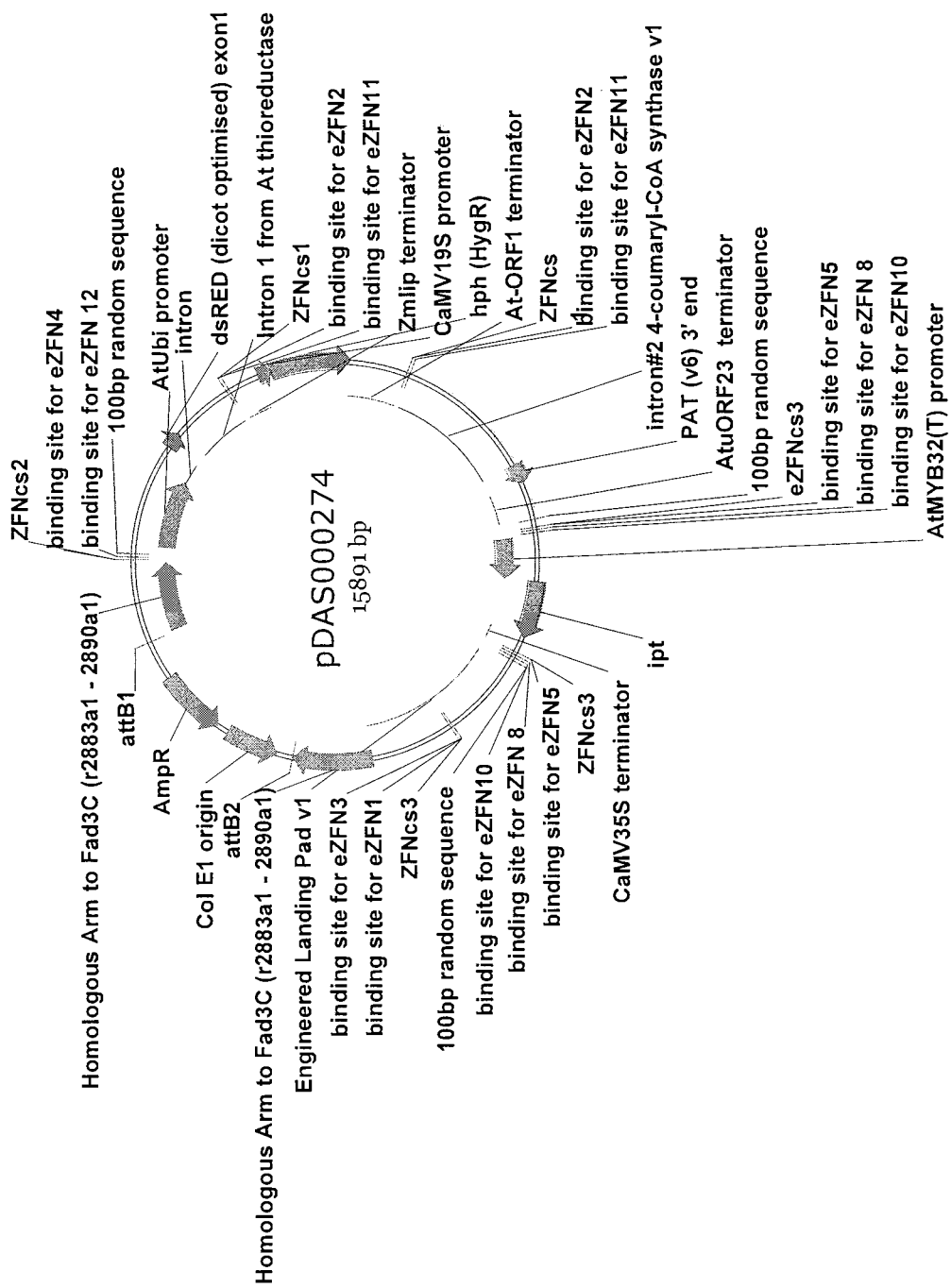
FIG. 12: Shows a plasmid map of pDAS000274.
Figure 13:
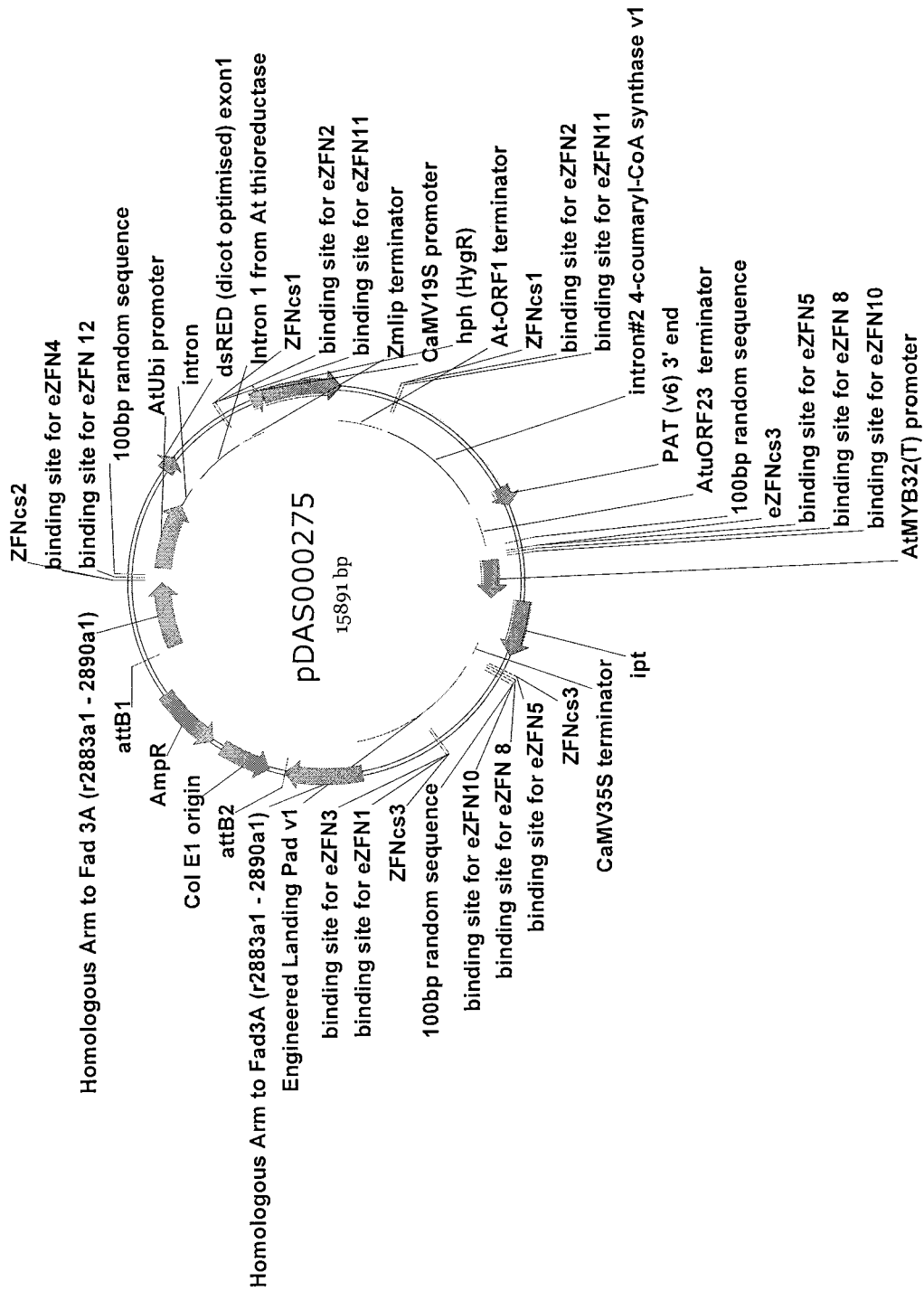
FIG. 13: Shows a plasmid map of pDAS000275.

Direct-Delivery Vectors for Precision Integration of ETIP in the Fad 3 Locus of Canola Standard cloning methods were used in the construction of the ETIP-containing vectors pDAS000271 (FIG. 9, T-strand insert as SEQ ID NO:142), pDAS000272 (FIG. 10, T-strand insert as SEQ ID NO:143), pDAS000273 (FIG. 11, T-strand insert as SEQ ID NO:144), pDAS000274 (FIG. 12, T-strand insert as SEQ ID NO:145), and pDAS000275 (FIG. 13, T-strand insert as SEQ ID NO:146) for specific integration into the FAD3A or FAD3C gene locus of *B. napus*. This construct has been designed to be delivered into canola protoplasts with the Zinc Finger Nuclease construct pDAB107828 or pDAB107829. A specific Zinc Finger Nuclease Construct will cleave the FAD3A locus and then the pDAS000273 or pDAS275 construct will integrate within the canola genome via a homology directed repair mechanism. Likewise, a specific Zinc Finger Nuclease Construct will cleave the FAD3C locus and then the pDAS000271, pDAS000272 or pDAS000274 construct will integrate within the canola genome via a homology directed repair mechanism. The ETIP consists of four expression cassettes (two incomplete) separated by additional ZFN recognition sequences and an Engineered Landing Pad (ELP) containing another ZFN recognition sequences. The additional ZFN recognition sequences are unique and have been designed to be targeted for the introduction of polynucleotide sequences within the ETIP and ELP transgene insertions. Similarly, the ZFN recognition sequences can be utilized for excision of polynucleotide sequences. The first gene expression cassette was an incomplete dsRED expression cassette and contained the promoter, 5' untranslated region and intron from the *Arabidopsis thaliana* Polyubiquitin 10 (AtUbi promoter) gene (Callis, et al., (1990) *J. Biol. Chem.*, 265: 12486-12493) followed by 210 bp of a dsRed gene from the reef coral *Discosoma* sp. (Clontech, Mountain View, Calif.) codon-optimised for expression in dicot plants (ds RED (dicot optimized)exon 1) followed by an intron from the *Arabidopsis thaliana* thioreductase-like gene (Intron 1 from At thioreductase: Accession No: NC_00374) and the 3' untranslated region comprising the transcriptional terminator and polyadenylation site of the *Zea mays* Viviparous-1 (Vp1) gene (Zmlip terminator: Paek et al., (1998) Molecules and Cells, 8(3): 336-342). The second expression cassette contained the 19S promoter including 5' UTR from cauliflower mosaic virus (CaMV 19S: Cook and Penon (1990) *Plant Molecular Biology* 14(3): 391-405) followed by the hph gene from *E. coli*, codon-optimised for expression in dicots (hph(HygR): Kaster et al., (1983) Nucleic Acids Research 11(19): 6895-6911) and the 3'UTR comprising the transcriptional terminator and polyadenylation site of open reading frame 1 of *A. tumefaciens* pTi15955 (At-ORF1 terminator: Barker et al., (1983) Plant Molecular Biology 2(6): 335-50). The third expression cassette was an incomplete PAT expression cassette and contained the first intron from *Arabidopsis* 4-coumaryl-CoA synthase (intron #2 4-coumaryl-CoA synthase v: Accession No: At3g21320/NC003074) followed by the last 256 bp of a synthetic, plant-optimized version of phosphinothricin acetyl transferase gene, isolated from *Streptomyces viridochromogenes*, which encodes a protein that confers resistance to inhibitors of glutamine synthetase comprising phosphinothricin, glufosinate, and bialaphos (PAT(v6) 3' end: Wohlleben et al., (1988) Gene 70(1): 25-37). This cassette was terminated with the 3' UTR comprising the transcriptional terminator and polyadenylation sites of open reading frame 23 of *A. tumefaciens* pTi15955 (AtuORF23 terminator: Barker et al., (1983) Plant Molecular Biology 2(6): 335-50). The fourth Expression Cassette was the ipt gene cassette and contained a 588 bp truncated version of the promoter and 5' UTR from the *Arabidopsis* DNA-binding protein MYB32 gene (U26933) (AtMYB32(T) promoter: Li et al., (1999) Plant Physiology 121: 313) followed by the isopentyl transferase (ipt) gene from *A. tumefaciens* and the 35S terminator comprising the transcriptional terminator and polyadenylation sites from cauliflower mosaic virus (CaMV 35S terminator: Chenault et al., (1993) Plant Physiology 101 (4): 1395-1396). For delivery to FAD3A or FAD3C, each end of the ETIP sequence was flanked by 1 kb of FAD3A or FAD3C genomic sequence from either side of the location of the double-stranded break induced by delivery of the ZFN encoded in FAD3A or FAD3c gene of *B. napus*.

The ETIP sequence was synthesized by a commercial gene synthesis vendor (GeneArt, Life Technologies). The 1 kb segments of FAD3A and FAD3C genome sequence were amplified from genomic DNA purified from leaf tissue of *B. napus* DH12075 using a Qiagen DNeasy plant mini Kit® (Qiagen, Hilden) following instructions supplied by the manufacturer. The 1 kb FAD3A or FAD3C sequences were ligated into the ETIP vector using T4 ligase (NEB, Ipswich, Mass.). Colonies of all assembled plasmids were initially screened by restriction digestion of miniprep DNA. Restriction endonucleases were obtained from New England BioLabs (NEB, Ipswich, Mass.) and Promega (Promega Corporation, WI). Plasmid preparations were performed using the QIAprep Spin Miniprep Kit® (Qiagen) or the Pure Yield Plasmid Maxiprep System® (Promega Corporation, WI) following the instructions of the suppliers. Plasmid DNA of selected clones was sequenced using ABI Sanger Sequencing and Big Dye Terminator v3.1 cycle sequencing Protocol® (Applied Biosystems, Life Technologies). Sequence data were assembled and analyzed using the SEQUENCHER™ software (Gene Codes Corp., Ann Arbor, Mich.).

Control Vectors

Figure 14:
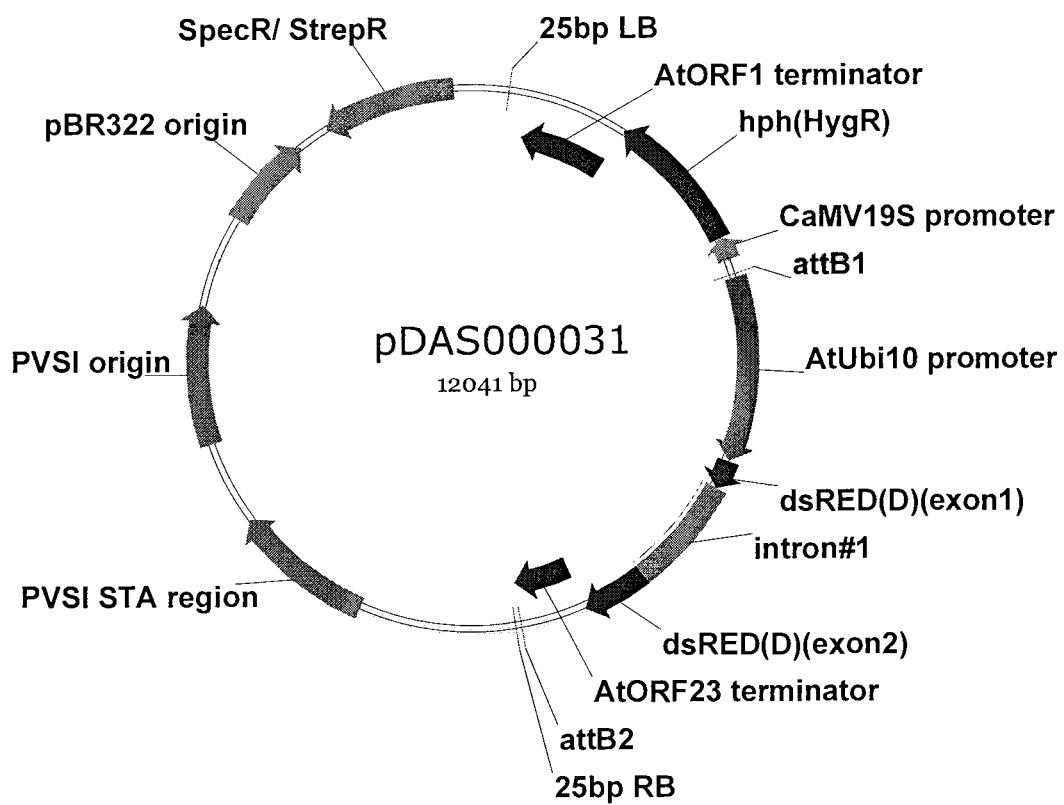
FIG. 14: Shows a plasmid map of pDAS000031.

A control vector was used to develop a Fluorescence Activated Cell Sorting (FACS) cell based sorting method. Standard cloning methods were used in the construction of a control vector, pDAS000031 (FIG. 14: T-strand insert as SEQ ID NO:147) consisting of two gene expression cassettes. The first gene expression cassette contained the Cauliflower mosaic virus 19s promoter (CaMV 19S promoter; Shillito, et al., (1985) *Bio/Technology* 3; 1099-1103): hygromycin resistance gene (hph(HygR); U.S. Pat. No. 4,727,028): and the *Agrobacterium tumefaciens* Open Reading Frame 1 3'UnTranslated Region (AtORF1 terminator; Huang et al., (1990) *J. Bacteria* 1990 172:1814-1822). The second gene expression cassette contained the *Arabidopsis thaliana* Ubiquitin 10 promoter (AtUbi10 promoter; Callis, et al., (1990) *J. Biol. Chem.*, 265: 12486-12493): dsRED (dsRED(D); U.S. Pat. No. 6,852,849) and an intron from *Arabidopsis* (intron #1; GenBank: AB025639.1): *Agrobacterium tumefaciens* Open Reading Frame 23 3'UnTranslated Region (AtORF23 terminator; U.S. Pat. No. 5,428,147) as an in-frame fusion with a trans orientation (e.g., head to head orientation). The plasmid vector was assembled using the IN-FUSION™ Advantage Technology (Clontech, Mountain View, Calif.).

Construction of Binary Vectors for Random Integration of ETIP in Canola

Figure 15:
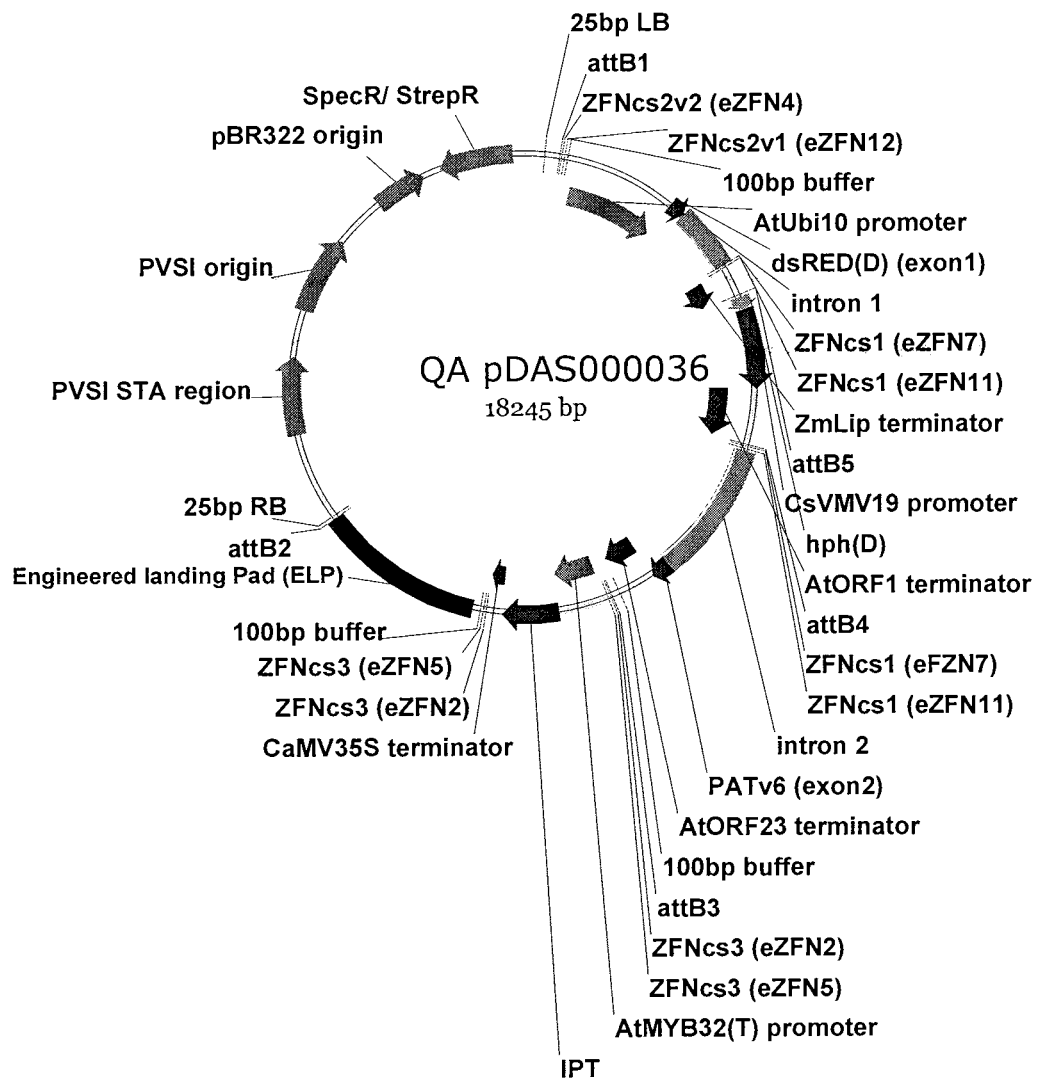
FIG. 15: Shows a plasmid map of pDAS000036.
Figure 16:
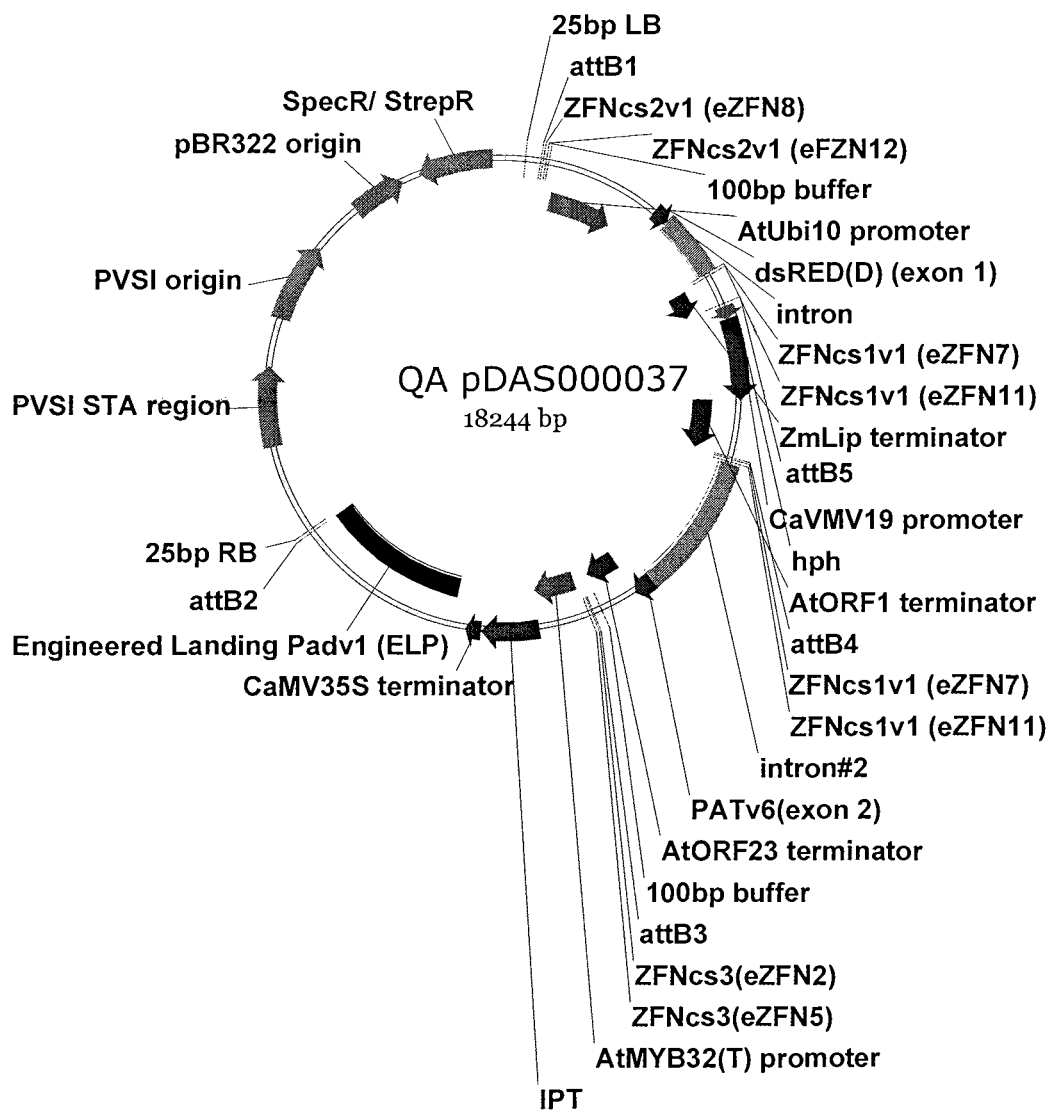
FIG. 16: Shows a plasmid map of pDAS000037.

Two binary vectors were constructed for random integration of an ETIP T-Strand sequence within the genome of *Brassica napus*. Standard cloning methods were used in the construction of the ETIP-containing vectors pDAS000036 (FIG. 15, T-strand insert as SEQ ID NO:148) and pDAS000037 (FIG. 16, T-strand insert as SEQ ID NO:149). The ETIP vectors consist of four expression cassettes (two incomplete expression cassettes) separated by ZFN recognition sequences and an Engineered Landing Pad (ELP) containing further ZFN recognition sequences. The first gene expression cassette was an incomplete dsRED expression cassette and contained the promoter, 5' untranslated region and intron from the *Arabidopsis thaliana* polyubiquitin 10 (AtUbi10 promoter) gene (Norris et al., (1993) Plant Molecular Biology, 21(5): 895-906) followed by 210 bp of a dsRed gene from the reef coral *Discosoma* sp. (Clontech, Mountain View, Calif.) codon-optimised for expression in dicot plants followed by an intron from the *Arabidopsis* thioreductase-like gene (Accession No: NC_00374) and the 3' untranslated region (UTR) comprising the transcriptional terminator and polyadenylation site of the *Zea mays* Viviparous-1 (Vp1) gene (Zm Lip terminator: Paek et al., (1998) Molecules and Cells, 8(3): 336-342). The second expression cassette contained the 19S promoter including 5' UTR from cauliflower mosaic virus (CsVMV 19 promoter: Cook and Penon (1990) Plant Molecular Biology 14(3): 391-405) followed by the hph gene from *E. coli* codon-optimised for expression in dicots (hph(D): Kaster et al (1983) Nucleic Acids Research, 11(19): 6895-6911) and the 3'UTR comprising the transcriptional terminator and polyadenylation site of open reading frame 1 (ORF1) of *A. tumefaciens* pTi15955 (AtORF1 terminator: Barker et al., (1983) Plant Molecular Biology, 2(6): 335-50). The third expression cassette was an incomplete PAT expression cassette and contained the first intron from *Arabidopsis* 4-coumaryl-CoA synthase (Accession No: At3g21320 (NC003074)) followed by the last 256 bp of a synthetic, plant-optimized version of phosphinothricin acetyl transferase (PAT) gene, isolated from *Streptomyces viridochromogenes*, which encodes a protein that confers resistance to inhibitors of glutamine synthetase comprising phosphinothricin, glufosinate, and bialaphos (PATv6(exon2); Wohlleben et al., (1988) Gene, 70(1): 25-37). This cassette was terminated with the 3' UTR comprising the transcriptional terminator and polyadenylation sites of open reading frames 23 (ORF23) of *A. tumefaciens* pTi15955 (AtORF23 terminator; Barker et al., (1983) Plant Molecular Biology, 2(6): 335-50). The fourth Expression Cassette was the ipt gene cassette and contained a 588 bp truncated version of the promoter and 5' UTR from the *Arabidopsis* DNA-binding protein MYB32 gene (U26933) (AtMYB32(T)promoter; Li et al., (1999) Plant Physiology, 121: 313) followed by the isopentyl transferase (ipt) gene from *A. tumefaciens* and the 35S terminator comprising the transcriptional terminator and polyadenylation sites from cauliflower mosaic virus (CaMV 35 S terminator; Chenault et al., (1993) Plant Physiology, 101 (4): 1395-1396).

The expression cassettes and ELP were synthesized with Multi-Gateway sites by a commercial gene synthesis vendor (GeneArt, Life Technologies). Entry clones were constructed of each expression cassette and ELP using BP clonase II enzyme Mix™ (Invitrogen, Life Technologies) and the pDONR221 vector Suite™ (Invitrogen, Life Technologies). The Entry clones were then used in a Multi-Gateway reaction with a Gateway-enabled binary vector using LR Clonase II Plus Enzyme Mix™ (Invitrogen, Life Technologies). Colonies of all assembled plasmids were initially screened by restriction digestion of miniprep DNA. Restriction endonucleases were obtained from New England BioLabs (NEB; Ipswich, Mass.) and Promega (Promega Corporation, WI). Plasmid preparations were performed using the QIAprep Spin Miniprep Kit™ (Qiagen, Hilden) or the Pure Yield Plasmid Maxiprep System™ (Promega Corporation, WI) following the instructions of the suppliers. Plasmid DNA of selected clones was sequenced using ABI Sanger Sequencing and Big Dye Terminator v3.1 cycle sequencing Protocol™ (Applied Biosystems, Life Technologies). Sequence data were assembled and analyzed using the SEQUENCHER™ software (Gene Codes Corporation, Ann Arbor, Mich.).

Example 5

Generation of ETIP Canola Plant Lines

Transformation of *Brassica napus*

The ETIP constructs (pDAS000036, pDAS000037), the DS-Red control construct (pDAS000031), and the FAD2A, FAD3A, and FAD3C site specific constructs (pDAS000130, and pDAS000271-pDAS000275) and accompanying Zinc Finger Nuclease (pDAB104010, pDAB10728, and pDAB10729) described in Example 4. The binary vectors were transformed into *Agrobacterium tumefaciens* strain GV3101: PM90. Transformation of *Brassica napus* protoplast cells was completed using the transfection protocol described in Example 3 with some modification.

The modifications to the protocol included the use of sodium alginate instead of Sea Plaque™ agarose. The transfection experiments in which both the Zinc Finger Nuclease construct and the ETIP construct were co-delivered into *Brassica napus* protoplast cells were completed at DNA concentrations comprising a 5:1 molar ratio of plasmid DNA. The other ETIP and control plasmid constructs were transformed at concentrations of 30 μg of plasmid DNA. As such, pDAS000130 consisted of a concentration of 27.8 μg of plasmid DNA and pDAB104010 consisted of a concentration of 2.2 μg of plasmid DNA. The other ETIP and control plasmid constructs were transformed at concentrations of 30 μg of plasmid DNA.

Additional modifications to the protocol included the propagation of whole plants from the transformed protoplast cells in medium containing 1.5 mg/mL of hygromycin. The propagation of whole plants required that the A medium was replaced every two weeks and the growth of the protoplast-derived colonies was monitored. After the protoplast-derived colonies had grown to approximately 2-3 mm in diameter, the colonies were transferred into individual wells of a 12-well Costar® plate (Fisher Scientific, St. Louis, Mo.) containing solidified MS morpho medium. The plates were incubated for one to two weeks at 24° C. under continuous dim light until the calli had proliferated to a size of 8-10 mm in diameter. After the protoplast cells had reached a diameter of 1-2 cm in diameter, the protoplast cells were transferred to individual 250 mL culture vessels containing MS morpho medium. The vessels were incubated at 24° C. under 16 h light (20 μMol m$^{-2}$ s$^{-1}$ of Osram L36 W/21 Lumilux white tubes) and 8 h dark conditions. Within one to two weeks, multiple shoots were visible. The shoots were transferred into 250 mL culture vessels containing MS medium after they reached a length of 3-4 cm. The 250 mL culture vessels were incubated at 24° C. under 16 h light (20 μMol m$^{-2}$ s$^{-1}$ of Osram L36 W/21 Lumilux white tubes) and 8 h dark conditions. The shoots were maintained in the culture vessels until they developed into plantlets at which time they were transferred to a greenhouse to grow to maturity.

Example 6

Molecular Confirmation of Integration of T-DNAS Containing ETIPS in Canola

Molecular Confirmation of Random Integration of ETIPS in Canola

Genomic DNA was extracted from leaf tissue of all putative transgenic plants using a DNeasy 96 Plant DNA extraction Kit™ or a DNeasy Plant Mini Kit™ (Qiagen). The genomic DNA from each plant was analyzed by PCR using primers designed to amplify virC from pTiC58 Forward (SEQ ID NO:150 CGAGAACTTGGCAATTCC) and pTiC58 Reverse (SEQ ID NO:151 TGGCGATTCTGAGAT-TCC) to test for persistence of *A. tumfaciens*, primers designed to amplify actin from *B. napus*; Actin Forward (SEQ ID NO:152 GACTCATCGTACTCTCCCTTCG) and Actin Reverse (SEQ ID NO:153 GACTCATCGTACTCTC-CCTTCG) to check the quality of the genomic DNA. Primers were designed to amplify the hph gene; HPH Forward (SEQ ID NO:154 TGTTGGTGGAAGAGGA-TACG) and HPH Reverse (SEQ ID NO:155 ATCAGCA-GCAGCGATAGC) encoded by the ETIP. Plants that did not give a product from virC primers but from which products of the correct size were amplified with primers to actin and hph were classified as transgenic.

A second screen was completed, where gDNA from each transgenic plant was analysed by PCR using five sets of primers designed to amplify the binary vector outside of the T-DNA region [(1F SEQ ID NO:156 ATGTCCACTGGGT-TCGTGCC; 1R SEQ ID NO:157 GAAGGGAACTTATC-CGGTCC) (2F SEQ ID NO:158 TGCGCTGCCATTCTC- CAAAT; 2R SE ID NO:159 ACCGAGCTCGAATTCAATTC) (3F SEQ ID NO:160 CCTGCATTCGGTTAAACACC; 3R SEQ ID NO:161 CCATCTGGCTTCTGCCTTGC) (4F SEQ ID NO:162 ATTCCGATCCCCAGGGCAGT; 4R SEQ ID NO:163 GCCAACGTTGCAGCCTTGCT) (5F SEQ ID NO:164 GCCCTGGGATGTTGTTAAGT; 5R SEQ ID NO:165 GTAACTTAGGACTTGTGCGA)]. Plants from which PCR products of the correct and expected size were amplified with primer sets 3 and 4 were considered to have backbone integration.

DNA from plants with no backbone integration was purified from 20 g of leaf tissue using a modified CTAB method (Maguire et al., (1994) Plant Molecular Biology Reporter, 12(2): 106-109). The isolated gDNA was digested with several restriction enzymes and 10 μg of gDNA was separated by electrophoresis on an agarose gel and transferred to membrane using a standard Southern blotting protocol. Membranes were probed using the DIG Easy Hyb System™ (Roche, South San Francisco, Calif.) following the manufacturer's instructions. Probes to each expression cassette to the ELP and to an endogenous control gene, actin, were amplified from the ETIP construct using the following primers: (IPT-F SEQ ID NO:166 TCTCTACCTTGAT-GATCGG; IPT-R SEQ ID NO:167 AACATCTGCT-TAACTCTGGC; dsRED-F SEQ ID NO:168 ATGGCT-TCATCTGAGAACG; dsRED-R SEQ ID NO:169 TTCCGTATTGGAATTGAGG; PAT-F SEQ ID NO:170 TTGCTTAAGTCTATGGAGGCG; PAT-R SEQ ID NO:171 TGGGTAACTGGCCTAACTGG; ELP-F SEQ ID NO:172 ATGATATGTAGACATAGTGGG; ELP-R SEQ ID NO:173 AGGGTGTAAGGTACTAGCC; Hph-F SEQ ID NO:174 TGTTGGTGGAAGAGGATACG; Hph-R SEQ ID NO:175 ATCAGCAGCAGCGATAGC; actin-F SEQ ID NO:176 GTGGAGAAGAACTACGAGCTACCC; actin-R SEQ ID NO:177 GACTCATCGTACTCTCCCTTCG).

The ETIP sequence was amplified and sequenced from all plants containing only a single copy of the ETIP. The sequence of each T-DNA insert was analyzed by direct sequencing of PCR products using the ABI3730xI™ (Applied Biosystems, Life Teachnologies). The T-DNA insert was amplified from genomic DNA, using Phusion Hot Start II Polymerase™ (Finnzymes, Thermo Fisher Scientific). The amplification reactions of the T-DNA were completed with multiple primer pairs to amplify overlapping sequences of approximately 2 Kbp in length. Each PCR product was sequenced with multiple primers to ensure complete coverage. The PCR reactions were treated with shrimp alkaline phosphatase and exonuclease I (Applied Biosystems, Life Technologies) to inactivate excess primer prior to the sequencing PCR reaction. The sequences flanking the T-DNA insert of each single copy ETIP line were identified by digestion of purified genomic DNA with eight restriction endonucleases followed by ligation of double-stranded adapters specific for the overhangs created by the restriction endonucleases. Following this ligation step a PCR was performed with a biotinylated primer to either the 3' or 5' end of the ETIP and a primer to each adapter. The PCR products were captures and cleaned on Ampure Solid Phase Reversible Immobilization (SPRI) Beads™ (Agencourt Bioscience Corporation, Beckman Coulter Company). A nested PCR was performed and all products were sequenced using ABI Sanger Sequencing and Big Dye Terminator v3.1 Cycle™ sequencing protocol (Applied Biosystems, Life Technologies). Sequence data were assembled and analyzed using the SEQUENCHER™ software (Gene Codes Corp., Ann Arbor, Mich.).

Southern Blot Analysis

Specific restriction enzymes were selected to digest gDNA samples prior to Southern probing. The putative transgenic plants were analyzed by digesting the genomic DNA with EcoRI and SwaI. Next, the digested gDNA and uncut gDNA samples were probed with either polynucleotide fragments comprising PATv6, IPT or ELP gene elements as these polynucleotide probe fragments enabled differentiation of multiple inserts in EcoRI digests as well as in the SwaI digests. Identified single copy transgenic plant lines were then further analyzed with all six probes to identify the presence of all essential elements of the inserted vector.

Accordingly, 67 independent events transformed with ETIP-pDAS000036 were sampled and tested for the presence of the transgene (hph), and the presence of vector backbone. Of the 67 plants tested, 47 were found to have the transgene integrated within the genome. From the 47 transgenic plants, 17 of the plants were found to contain vector backbone (Table 14). The remaining 30 plants that contained no significant portion of vector backbone (absence of Ori or SpecR) were sampled for Southern analysis. As a general rule, the plants were screened initially with the IPT probe, and plant lines identified as putative single copy lines were further tested with probes comprising the dsRED, PAT, ELP and hph gene elements in order to confirm the presence of the whole cassette.

Likewise, 52 independent events transformed with ETIP-pDAS000037 and surviving in soil were sampled and tested for the presence of the transgene (hph), and the presence of vector backbone. Of the 52 plants tested, 48 were found to have the transgene integrated within the genome. From the 48 transgenic plants, 23 of the plants were found to contain vector backbone as well and 3 plants were not tested (Table 14). The remaining 22 plants that contained no significant portion of vector backbone (absence of Ori or SpecR) were sampled for Southern analysis. These transgenic plants were initially screened with the IPT probe, and the plant lines were identified as putative single copy lines, and were further tested with the dsRED, PAT, ELP, hph and actin probes in order to confirm results. Once the identification of 5 independent single copy lines were obtained, Southern analysis was terminated on the remaining plants. In total, 11 ETIP-pDAS000037 lines underwent Southern analysis.

TABLE 14

Summary of +/− transgene and +/− vector backbone PCRs results

Confirmation of transgene - Endpoint PCR

|  | Independent Events Surviving in Soil | Independent Events Sampled | Independent Events Tested | Independent Events Positive for Transgene |
|---|---|---|---|---|
| pDAS000036 | 67 | 67 | 67 | 47 |
| pDAS000037 | 52 | 52 | 52 | 48 |

Presence of Backbone - Endpoint PCR

|  | Independent Events Tested | Independent Events with no Ori or Spec$^R$ |
|---|---|---|
| pDAS000036 | 47 | 30 |
| pDAS000037 | 48 | 22 |

Results of ETIP Transgenic Canola Transformed with PDAS000036 and PDAS000037

The transgenic *Brassica napus* events which were produced via transformation of pDAS000036 and pDAS000037 resulted in the production of single copy, full length T-strand insertions. Three to four events for each plant were fully characterized, and were putatively mapped to specific chromosomes within the *Brassica napus* genome. Although a few single base-pair rearrangements occurred during the T-strand integration, the selected events contained full length expression cassettes which are capable of driving robust expression of the transgene. The selected $T_0$ events were grown to the $T_1$ stage of development. The $T_1$ were res-screened using the above described PCR assays to determine the zygosity of the integrated T-strand. Screened events were categorized as homozygous, hemizygous, or null.

The ETIP sequence was amplified and sequenced from all transgenic events containing only a single copy of the integrated ETIP sequence. The sequence of each T-DNA insert was analyzed by direct sequencing of PCR products. The T-DNA insert was amplified from genomic DNA, using Phusion Hot Start II Polymerase™ (Finnzymes, Thermo Fisher Scientific). Next, the T-DNA was amplified with multiple primer pairs to amplify overlapping sequences of approximately 2 Kb in length. Each PCR product was sequenced with multiple primers to ensure complete coverage. The PCR reactions were treated with Shrimp Alkaline Phosphotase and Exonuclease I (Applied Biosystems, Life Technologies) to inactivate excess primer prior to the sequencing PCR reaction.

The sequences flanking the T-DNA insert of each single copy ETIP line was identified by digestion of purified genomic DNA with eight restriction endonucleases followed by ligation of double-stranded adapters specific for the overhangs created by the restriction endonucleases. Following this step a PCR reaction was performed with a biotinylated primer to either the 3' or 5' end of the ETIP and a primer to each adapter. The PCR products were captured and cleaned on Ampure Solid Phase Reversible Immobilization™ (SPRI) beads (Agencourt Bioscience Corporation, Beckman Coulter Company). A nested PCR was performed and all products were sequenced using ABI Sanger Sequencing and Big Dye Terminator v3.1 cycle sequencing protocol (Applied Biosystems, Life Technologies). Sequence data were assembled and analyzed using the SEQUENCHER™ software (Gene Codes Corp., Ann Arbor, Mich.). Eight ETIP lines were identified and selected for flanking sequence analysis (Table 15). The left and right flanking sequences (also described as border or junction sequences) are provided as SEQ ID NO:431-SEQ ID NO:446, the underlined sequences indicated plasmid vector, the non-underlined sequences indicate genomic flanking sequence.

TABLE 15

Details of single copy events used in flanking sequence studies

| Plasmid Description | Event name | Barcode | Left Hand Border SEQ ID NO: | Right Hand SEQ ID NO: |
|---|---|---|---|---|
| pDAS000036 | em02-5788-1-1 | 228688 | 431 | 432 |
|  | ad58-5784-2-1 | 232502 | 433 | 434 |
|  | ad58-5898-10-1 | 237143 | 435 | 436 |
| pDAS000037 | lf1-6139-2-3 | 234576 | 437 | 438 |
|  | bm56-6315-1-1 | 234703 | 439 | 440 |
|  | ad58-6372-1-1 | 240653 | 441 | 442 |
|  | ad58-6620-4-1 | 242268 | 443 | 444 |
|  | ad58-6620-17-1 | 242293 | 445 | 446 | pDAS000036 Event details: em02-5788-1-1
Left border flanking (SEQ ID NO: 431)

TCGAGATTGTGCTGAAGTAAACCATTTTACTTCAAATCTATTTTTAACTATTTACTTT

TATTAAGGAGAGAAACTTTGCTGATTAATTCAAATTAGTGATCATTAAGATTCCAAA

GATTCCGATTTAGAAAAGTCAAAGATTCAAAGAACAAGTCTAGGTCCTCATGGCTCA

TGTTGCATCCGATTCACCATCCACTCATCTTTCATATCTTCCTCCACTGTCTCTCTAGA

AACAACTCATTTAATTTAGAAAACTCCTTTTTCAATTTAGAAATATTAAAGTTTATCA

CAATGTATCAATTAAATATTATCCGATGACTCATTCATAGTCAGGACCTTGCTGTCTG

TGTCGTCCGTAATTATTATTTCAATACAAAACAAATATATGTTCACTCAGAAAATTA

CGGCGCAATCATCTAATTTTGTGGACCAAAATAAATAGCGTAGCTTCGAGATTTCAA

AGTTGTGTTCAAATTTAATTTTGATTTCCGTTCCTCGTATACTCTTTTATGTATAGAA

AATAATAATATCCACTACTAGTAGTTGATAACTACATTACATATATTAAAATTATGA

TGTCACATTGCGGACGTTTTTAATGTACTGAATTAACGCCGAATTGAATTCGAGCTC

-continued

GGTACCCGGGGATCCTCTAGAGTCGACCTGCAGGCATGCAAGCTTAGCTTGAGCTTG
GATC em02-5788-1-1 Left border flanking
(SEQ ID NO: 432)
CATAACCACCATCTCAAACAATAGAACTTCCTAAGTGAAGCAATGACTTCAAATCTA

CTTGAAGGCATGGAGTATAAGCCATGTTCCTTTCAGAGGGGACTGTACTTCTGTAGA

TTACTTTCCCTCATTAACCAGATCTGGCCGGCCTACCCAGCTTTCTTGTACACATAGC

GACCGAGCTCGAGCCGAAGTTCGGTCGCTGTTTCACTGTTTGGGAAAGCATCAGTAA

CGCAGAAGACATAATTAAAAATTAATTATATATGGTAGTTTTTCTAGATTCTCCACT

ATACCTCATTGTGATTGAAAAACAACTATATATATATATATATATGTATTTAAAATT

AAGAAATCATTAAATCGTACCATAATGCAGAAAACTTTATAAGTTCCTATTCTTTTG

TCAAGATGAGTAGATGACACATCATGTACCACATAACATAACCATAATGGTGCGAT

ACCATACCAAAACTTAATTTAGAAACTAATTAAAATTTTGGTAGTTTAAGATTCCTC

CTAATGGTTGTCAAAAAAAAAAAAAGATTCCTCCTAATACATGGTAGAATATATTTT

TGAGTTAAAATGAAAGTAAAATCTTCAAATTAGTCATAAGGAAATTCTAAAAAACA

TCGACTTTCTTTATAAAGATCCCATTGTAATTTTAGATGATTAATTTTATCCCAATCC

AATTAAGAATTGTACACATCGGCCTCTATATATATCAAACACCTAAAA pDAS000036 Event details: ad58-5784-2-1
Left border flanking
(SEQ ID NO: 433)
CGATTTGCAGCTATAATCAATCACACCTTATCGTTCTTTCAAAGAAAAATCGAAAGT

TGTAAACTTTATCAGCCTGTGTAGTGATTATTTCAATTTGATAAAGAAAAAAAAAGG

CTTAGCTTTATTTGGTTTTTTGTTACAATCTTGATTAATTTTAGATTAGCACTCTGATT

CTAGCGGAACATGAGAGTGGTTCCATCAAACCTCAGACAGTGAGCACAGTGGTTGC

AGCAAACCATTTGGGTGAGAGCTCTTCAGTTTCTTTGCTATTAGCTGGTTCTGGCTCT

TCTCTTCAAGAAGCTGCTTCTCAAGCTGCCTCTTGTCATCCTTCTGTTTCCGAGGTAA

CTAACTACATTCTTCATTTGTCCTTTTTTCTTGTGGGTCTTAAATGTTYGTGCTTTTCT

TTATAGGTACTTGTTGCTGATTCAGATAGATTTGAGTACCCTTTAGCTGAACCTTGGG

CTAAACTGGTTGACTTTGTTCGCCAACAAAGAGATTACTCTCACATCCTTGCCTTCCT

CTAGCTCATTTGGCAAGAACATACTTCCTCTAGACAACTTAATAACACATTGCGGAC

GTTTTTAATGTACTGAATTAACGCCGAATTGAATTCGAGCTCGGTACCCGGGGATCC

TCTAGAGTC ad58-5784-2-1 Right border flanking
(SEQ ID NO: 434)
CCTGTCATAACCACCATCTCAAACAATAGAACTTCCTAAGTGAAGCAATGACTTCAA

ATCTACTTGAAGGCATGGAGTATAAGCCATGTTCCTTTCAGAGGGGACTGTACTTCT

GTAGATTACTTTCCCTCATTAACCAGATCTGGCCGGCCTACCCAGCTTTCTTGTACAA

AGTGGTGATAAACTATCGCCGGCCTACCTCGCGTTGCTGCTCTTTTAGATGTCTCTCC

TGTTACTGATGTTGTCAAAATCTTAGGATCCAATGAGTTTATCAGGTATACTTCTATC

ATGTATTGCTTGAGATTTTGGAGTGTTAGTAAAGATTTCAATAAAAGAATTTTTTCA

AACAAAATTTTGGGGGCTTGAAGCTAATGTTTGGAAATATGTAACGGAGTTTAAATC

TTTTGGCAGGCCTATATATGCGGGAAACGCCTTGTGTAGAGTTCGCTATACTGGTGC

TGGTCCTTGTGTGTTGACTATTAGAACTACATCTTTTCCTGTTACCCCAATAACTGAG

TCAAAGAAAGCTACTATCTCTCAGATTGATCTCTCGAAATTCAAAGAAGGTTTGTTT

-continued

AGTATTATTCTCTTGTGCATAGCCTTTTTGCTTTTTTTTTTTTATAAAAAAGTTGAG

TATGCTTATTGCCCATTGCA pDAS000036 Event details: ad58-5898-10-1
Left border flanking
(SEQ ID NO: 435)
TAATTTCATTTTCGTCATTTTGGTAAAGTAACAAAAGACAGAATATTGGTTAGTCGT

GTTGGTTAGGAATAAAATAAAGAACGTGGACATCGTGGAATAAAAATATTCAGACA

AGGAAACTAACAATAAAACAGTAATGAACATGGTTCTGAATCTCATCTTTGTGTATC

TCCAATGGAATCCACCGCCACGAATCAGACTCCTTCTCCAAGCTCCACCGTCGACGA

TGACAATGGCGACGGTGTCTATACCGACGAATTTACCAAACTACCCCCGGACCCGG

GGATCCTCTAGAGTCAACAAATTGACGCTTAGACAACTTAATAACACATTGCGGACG

TTTTTAATGTACTGAATTAACGCCGAATTGAATTCGAGCTCGGTACCCGGGGATCCT

CTAGAGTCGACCTGCAGGCATGCAAGCTTAGCTTGAGCTTGGATCAGATTGTC ad58-5898-10-1 Right border flanking
(SEQ ID NO: 436)
CGGCCTACCCAGCTTTCTTGTACAAAGTGGTGATAAACTATCAGTGTTTGATTAAAG

ATAAAATTTGATTTTTCATTACATAATAATCCATTAATTTTCACGCACGTGGAACCCA

TTTGGTGTACTTCCACGTCCTCTAAGAGAGCACTGACCCACTCATCAAAAAGATACA

TCTTTATAAGCCCCTTCATCGTCACACAGACACACTTCCCTCTCAATTATTCCATA

TTCTCCTAATTTCTAATTGTTACACCTCAACACATTAGATTCGTACCAAACAAAAC

GATTAGCTCCCAAGCCTAAGCTTTTATTTCCTTATAATTTTTCTTGGGTTTCTCTCTAT

AAAGAATGCAAATGACTGAGAGAGGCCGAGCCATGTGGCACACGTCCCTAGCCTCG

GCATTCCGCACAGCTCTAGCTTGCACAATCGTTGGTGCGGCTACGCTCTACGGACCC

GAGTGGATCCTCCGTTTTGTGGCATTCCCGGCGTTTTCTTACGTCACGGTCATTCTCA

TCATTACGGACGCCACGCTAGGCGACACACTACGTGGCTGCTGGCTAGCCCTTTACG

CCACATGTCAGAGCGTTGCACCGGCTATCATTACACTAAGGCTTATAGGACCAGCTC

GGCTCACGGCCGG pDAS000037 Event details: 1f31-6139-2-3
Left border flanking
(SEQ ID NO: 437)
TTCTTTCCATCAGTTCTTCGGCACCTTCCTGGCTCTGCGTCTATCTTTCTTTCCATCCC

GGCCCATCTCGTACACATTCCACCCAACTACACAAACACGTTATAGTCTTTTACATT

ATGACCAAATCAACCCTAAAGATACAGCCTTTATAAAAAATATAGGGGTCAAAGCA

AAGAAGAGAAAGTTTGCTTACAGTGTGGAGAAAAGAAGTTGGAAGATGAGGAGTA

AGAAGAAGAAGAGAAGAGAAAGGGTCTTCTGATGAGGAATAGGAGATAAGGTGGA

ACTGGAATGTTTGCCGCTAAATACTTGAAGACAAGAGCTTGATTTTCAAGCTCTTCC

CATTGTGACTCAGTGAAAGGGATCCTAGTCGTCATGAAGAGATAGAGAAATTGAT

GATGAAGGAGGTCTGATGAAGAGAAGAGAGAGAGAGATATTACACAAAGAGGG

TTGTATTGCAAAATTGAAAGTGTAGAGAGTAGTAGGTAAGTTTTTATTAATAATG

TTGTTCACACCTGCAGTCTGCAGAATATTGTGGTGTGAACAAATTGACGCTTAGACA

ACTTAATAACACATTGCGGACGTTTTTAATGTACTGAATTAACGCCGAATTGAATTC

GAGCTCGGTACCCGGGGATCCTCTAGAGTCGACCTGCAGGCATGCAAGCTTA

1f31-6139-2-3 Right border flanking
(SEQ ID NO: 438)
TTCAATCTACTTGAAGGCATGGAGTATAAGCCATGTTCCTTTCAGAGGGGACTGTAC

TTCTGTAGATTACTTTCCCTCATTAACCAGATCTGGCCGGCCTACCCAGCTTTCTTGT

-continued

ACAAAGTGGTGATAAACTATCAGTGTTTGAACATATATATACGCATAATATTCTCAG

AACCCGACCCATTGGTTGACTCGGATCAAGATCGACCCGATCCGACCCGGTTAAAA

GCACGTCGTCTCCTTTGGTTCGCCCCTTATATTCGACGAGTGAGTTCGATTGGATCGC

TGTTTGTCATTTCTCACTACCTTAAGAAAAAAAAAAGGTGCGTCTCTCTCTCACCTT

TACCGCTCACTTACCTCTCAGATCTGACATCGATTTTCCAAATCTTC:TCCAGGTACTC

TCTCTCCTGGCCGTTGACGGTCCCGTCCCGGCCGTGGATCTGATTTCGCCGCGATCTG

AGGTCAAGCATGGCGGCAGCTAACGCCCCCATCACGATGAAGGAGGTCCTAACGGT

GAGTCCCGCCTCCATTTTTAGTAACATA pDAS000037 Event details: bm56-6315-1-1
Left border flanking
(SEQ ID NO: 439)
TACATCGCGATTCATCCTGGTTTGATTAGAATGACGAGGAAGTTGTCATATTCCCAA

ACAGGAAAATTGGGATCGCCTTATTTGAAAGTGGGATAACTTCTTCATCTTAATTCT

TATGAGAATTATTCCACTTCCTGGTGATTCTCCACTACTTTTTGTATATAAATACAGC

TTCTTACATCGCGATTCATCCTGATTTGATTAGAATGACGAGAAAGTTGTCATATTCC

CAAACAGGAAAACTGGGATCACCTGATTTGAAAGTGGGATAACTTCTTCATCCTAAT

TCTTATGAGATTTATTCCACTTCCTGGTGATTCTCCACTTCTTTATGTATCCAAATAC

ATCTTCTTACATCGCGATTCATCCTGGTTTGATTAGAATGACGAGGAAGTTGTCATAT

TCCCAAACATGAAAACTGGGAAAGTGGGATTGACGCTTAGACAACTTAATAACACA

TTGCGGACGTTTTTAATGTACTGAATTAACGCCGAATTGAATTCGAGCTCGGTACCC

GGGGATCCTCTAGAGTCGACCTGCAGGCATGCAAGCTTAGCTTGAGCTTGGAT bm56-6315-1-1 Right border flanking
(SEQ ID NO: 440)
CCACCATCTCAAACAATAGAACTTCCTAAGTGAAGCAATGACTTCAAATCTACTTGA

AGGCATGGAGTATAAGCCATGTTCCTTTCAGAGGGGACTGTACTTCTGTAGATTACT

TTCCCTCATTAACCAGATCTGGCCGGCCTACCCAGCTTTCTTGTACAAAGTGACGAT

AAACTATCAGTCTTTCAAAGCGCATCTATGGCTAGTCATCACGGTTTTTAACTGTTTT

ACGAAGTCGCGGAGAGGCTCGTCTTCTCCCTAGGATAAACTGCAGAGGTCGACATC

GGAGGTTTCTCGATCTATGAACATAGAGTACTGTTTGAGAAACTCCGAGGCGAGTTG

GCGGAAACTCCCTATAGAGTTTTTCTTTAGACAAGAGAACCACTCAAGCGCTGCTTC

GCGGAGGTTCTCGACGAAGAGGCGGCATTCGCCGGCATCTCTTTCTCTATCTTTAAA

CTTGGCTCTTCCCATCGCGATCTGGAAAGCCTGCAAGTGTGCCTTAGGATCGGTTGT

ACCATCGTAAGGAGCCACTTTGACTTTATCAGGATCCGAAACCGTAGTTTCGGTGAT

GCGGGTGGTGAAGGGCGTTTTTCGAGACTCCTCGAGGAGTAGGGTGATATCGAGTG

CAGTACTAGTAGCGTGATGATTTGGGATTTCACCGCTCTAACCTCCGCAGCCGTTTTC

A pDAS000037 Event details: ad58-6372-1-1
Left border flanking
(SEQ ID NO: 441)
TTTTACAGTGTTAGAAGAAGTGGATGAAGCTGAAATTGAATTTTCAAACTCGTTCAG

CTTGACTAGAGGTGGGAGAGAGTCAAAGCCTCCCATCAAGTACCAAAACATGGAAT

AGAAGACAGTCCGAGGGAGAGGAAACCGTGGCCGACGAGGCCGTGGCTCCTATCAT

TAACTAGTGTCTTTCTTACTATTAATGGTTTATTAAGTCTCAGCCTTTGTTGTTTCATT

GGTTTGAGATTCACTCATACATGAAACTTGTTTCATTCCAGCTTTTCCAAACTATAAG

-continued

AATATTTCCAATCTTATCTTGTAATAGTTTAAGTTTTAAATTGAAAGCCCTTAGTTCA

AAAAACAAAAAAAAAAAATTAGCCCTTGAATTTATATATAATCACGACGGCCATAT

TTGGCAGCTACACTGATATGTTTTCAATTGGCTGACAGGCCTTGAGCAGGGTTTGCT

GGGTATATTGGTAGGAAGATGTGTTGCGAGGTTGAAGCCTCATTTAGGCAATATAAA

CATGATCATTAGCGTTATGTCATTAGTTATACTTATACGTAGACTAAGTAACCCACT

AAAGGTTGCTGATTCCTTTTGTATCGAC<u>TAACACATTGCGGACGTTTTTAATGTACTG</u>

<u>AATTAACGCCGAATTGAATTCGAGCTCGGTACCCGGGGATCCTCTAGAGTCGACCTG</u>

<u>CAGGCATGCAAGCTTAGCTTGAGCTTGGATCAGATTGTCGTTTCCCGC</u> ad58-6372-1-1 Right border flanking (SEQ ID NO: 442)
<u>CATGTTCCTTTCAGAGGGGACTGTACTTCTGTAGATTACTTTCCCTCATTAACCAGAT</u>

<u>CTGGCCGGCCTACCCAGCTTTCTTGTACAAAGTGGTGATAAACTATCAGTGTTTGAC</u>

TGAATTTTAATTTCTAATTTTTGTAAAAAATTTGTATAACCTCAAATTATTAAAAGGC

GGATTTTATTAGAATTATAACTAAATTATCTATAACTCCAAAATTTTGACAATCAATC

ATGTCTATATCTTTATTTTTTTGCTAAATTATCATGTCTATATCTTTTCTTTCTTCCAA

ACTTACTTGAGACTAAAAGTCTTTATAAATTTTGATAGGAGTTCCACACACAAACAA

AAACAAAACAAATATTTTTCATCAAGGGATACTTATTTAACATCACGGATTCACAGT

TTATTAACAAAAATCCAAACAAAGACTGAAAGACAGAAGATTCAATCTAACAATAG

TCGGCAAACACCAGTGATTAACTAACGAAATAAATTAACAAGTGGTCAGATCTTCG

GGAAA pDAS000037 Event details: ad58-6620-4-1
Left border flanking (SEQ ID NO: 443)
TAATTTCATTTTCGTCATTTTGGTAAAGTAACAAAAGACAGAATATTGGTTAGTCGT

GTTGGTTAGGAATAAAATAAAGAACGTGGACATCGTGGAATAAAAATATTCAGACA

AGGAAACTAACAATAAAACAGTAATGAACATGGTTCTGAATCTCATCTTTGTGTATC

TCCAATGGAATCCACCGCCACGAATCAGACTCCTTCTCCAAGCTCCACCGTCGACGA

TGACAATGGCGACGGTGTCTATACCGACGAATTTACCAAACTACCCCCGGACCCGG

GGATCCTCTAGAGTC<u>AACAAATTGACGCTTAGACAACTTAATAACACATTGCGGACG</u>

<u>TTTTTAATGTACTGAATTAACGCCGAATTGAATTCGAGCTCGGTACCCGGGGATCCT</u>

<u>CTAGAGTCGACCTGCAGGCATGCAAGCTTAGCTTGAGCTTGGATCAGATTGTC</u> ad58-6620-4-1 Right border flanking (SEQ ID NO: 444)
<u>CATAACCACCATCTCAAACAATAGAACTTCCTAAGTGAAGCAATGACTTCAAATCTA</u>

<u>CTTGAAGGCATGGAGTATAAGCCATGTTCCTTTCAGAGGGGACTGTACTTCTGTAGA</u>

<u>TTACTTTCCCTCATTAACCAGATCTGGCCGGCCTACCCAGCTTTCTTGTACAAAGTGG</u>

<u>TGATAAACTATCAGTGTTTG</u>AAATAATCGGATATTTAATTTTCTTAGACAGTTCATTA

GTAGTTGATCTTAAACATTCACGTTTTATTTTCTTTTCTTTTCGAATGCTAGACTCTAG

TTTGGTACCCATAGGATTCGAGTTACATGAAGCTATTGACACTGGGAGTGCTTCAAG

ATCTGTAAGAGGCAAAGATTCACAAACAGAACGTGATTTCTTGGATAGTGATGTGG

AGATTGTGATAAGAACCAGCATGAGTATTACTTTTACTGCCCCTGCTGTGGTGAAGA

CATCACCAAAACAGTCAAGCTCGTGAAGAAATCAGATATTCAACCCGCAAAAAAAT

CTGACAATGCAAATAAACCTATTGACACTAAGAATGGTTCAAGATCCGAAGACAAG

AAGACAAAAAATTTGTCCTGGCTCCCTGCTTATCTCCAGAAGCTGTTTCTTTCTGTTT

```
-continued
ATGGCCACATCAAAGACAAAGGTACCCTTTCTTTTGGTGCCTTTGGTGTGGACAGGT

GTGATTGACTTTGGTTTCTTGGCAGATTCAGGCAAGATAGAGGTTGATTCAAAGTCA

ACTAACAATGATCTTGGTACCAATAGTGAGGA pDAS000037 Event details: ad58-6620-17-1
Left border flanking
                                                        (SEQ ID NO: 445)
CCGCCTTGAACAACCGCTCCGCCGTTGCTCAGTACATTATCGAGGTTACCAAAAAGT

TCAATCCTTTATGCTTGTTTTGGCGTGTGATTCGTTACGAATGAGTAAAATTGATTTG

GTTTTTTTCTTTGAACAGCATGGTGGAGATGTGAATGCGACGGATCATACGGGGCAG

ACTGCGTTGCATTGGAGTGCGGTTCGTGGTGCGGTGCAAGTTGCGGAGCTTTTGCTT

CAAGAGGGTGCAAGGGTTGATGCTACGGATATGTATGGATATCAGGTTCTAACCACT

TCCTCTTTCTTTGTGGAGATTGTCTTTTTGTTTCAATGCTAGTCAACTTCTTTCTTTCTT

TCACAAAACTAAGTAGTATTGCTTGTTTTGTTGTCGTTGCATTTTTTCTTATGGCTGT

GTTCTGAGGTTCATGTAGGTATATAAGCACTTCGTACTTTGCCACTTGTTTCATTTAG

GCAACATTGTGCACATATCTAAGTAGTTGGTCTTTGTAAAATTAGTTTGTTTGTCTTC

AAAGTATATTGAGCAGTTTCATGACTCATTATTCAAAGGTTTGTCTAAATTAGAGAG

AACTTTCATTTTGCCTGGATTTAATCAGCATTTAGAATGTTTATAGCGATATCATTTT

TAGTTGAAAAAATCTCAACAAATTGACGCTTAGACAACTTAATAACACATTGCGGAC

GTTTTTAATGTACTGAATTAACGCCGAATTGAATTCGAGCTCGGTACCCGGGGATCC

TCTAGAGTCGACCTGCAGGCATGCAAGCTTAGCTTGAGCTTGGATCAGATTGTCGTT

TC ad58-6620-17-1 Right border flanking
                                                        (SEQ ID NO: 446)
GTATAAGCCATGTTCCTTTCAGAGGGGACTGTACTTCTGTAGATTACTTTCCCTCATT

AACCAGATCTGGCCGGCCTACCCAGCTTTCTTGTACAAAGTGGTGATAAACTATCAG

TGTTAGATCCCCGACCGACCGCCCATCCTGGACGGCCTCGTGCATGCTGATGTTGTC

AAAATCTTAGGATCCAATGAGTTTATCAGGTATACTTCTATCATGTATTGCTTGAGAT

TTTGGAGTGTTAGTAAAGATTTCAATAAAAGAATTTTTTCAAACAAAATTTTGGGGG

CTTGAAGCTAATGTTTGGAAATATGTAACGGAGTTTAAATCTTTTGGCAGGCCTATA

TATGCGGGAAACGCCTTGTGTAGAGTTCGCTATACTGGTGCTGGTCCTTGTGTGTTG

ACTATTAGAACTACATCTTTTCCTGTTACCCCAATAACTGAGTCAAAGAAAGCTACT

ATCTCTCAGATTGATCTCTCGAAATTCAAAGAAGGTTTGTTTAGTATTATTCTCTTGT

GCATAGCCTTTTTGSTTTTTTTTTTTTATAAAAAAAGTTGAGTATGCTTATTGCCCAT

TGC
```

Mapping of ETIPS

For each transgenic event containing a single copy insertion of the ETIP, the flanking sequence was taken following manual assembly and used as the query in a local BLAST analysis. There were a total of eight plants that had single copy integrations identified by this process (Table 16 and Table 17). A collection of 595,478 genomic derived shotgun sequences from *Brassica oleracea* were downloaded from the NCBI GSS database and formatted as a nucleotide BLAST database. The flanking ETIP sequences were then BLASTn compared to the database and all matches were manually examined. The most significant sequence match to the flanking ETIP sequence from the *B. oleracea* database was then taken and aligned against the online *Brassica rapa* genome sequence (http://brassicadb.org/brad/blastPage.php) where the position in the genome that had the most significant sequence match was also retrieved. In instances where a only the 5' or 3' flanking sequences provided significant matches with the *B. oleracea* genome sequences, it was assumed that the unaligned or unmatched sequence had either; identified missing sequence from the database, or that there had been significant genome rearrangements generated during the integration of the ETIP. For the samples that generated significant BLASTn matches from the analysis the flanking ETIP sequence, the most significant *B. oleracea* GSS matching sequence along with the most significant matching sequence from the *B. rapa* genome, were then manually aligned in Sequencher™ v5.0 software (Gene Codes Corp., Ann Arbor, Mich.) for each of the eight single copy ETIP plants. The three sequences were then compared and the most similar sequence from either of the diploid *Brassica* species compared to the flanking ETIP was designated the genome that the ETIP was located in. For the majority of the samples significant variation did exist between the two diploid *Brassica* genome sequences and the *B. napus* derived flanking ETIP sequence showed a predominant association with one or other of the diploid sequences. There were instances however, where there was insufficient sequence variation between the diploids and a linkage group assignment may have been possible but a sub-genome assignment was not possible. The specific genome location was then predicted from the location from the *Brassica rapa* genome sequence. In instances where the ETIP was identified as being integrated into the *B. oleracea* C genome, the comparative synteny between the diploid *Brassica* genomes described in Parkin et al. (Genetics 2005, 171: 765-781) was used to extrapolate the genomic location into the *Brassica napus* C sub-genome. In addition the sequences identified were BLASTn compared to the *Arabidopsis thaliana* genomes coding sequences (TAIR 9 CDS downloaded from http://arabidopsis.org/index.jsp) and the identity of any gene sequences disrupted were identified, as well as a confirmation of genomic location following the *Arabidopsis Brassica* synteny described in Schranz et al. (Trend in Plant Science 2006, 11, 11: 535-542).

TABLE 16

BLAST search and predicted the location of these above sequences (predicted locations in *Brassica napus* genome).

| Event/Vector Name | One copy of each cassette detected by Southern | LB Flanking Sequence | RB Flanking Sequence | Predicted location |
|---|---|---|---|---|
| pDAS000036 | | | | |
| em02-5788-1-1 228688 | yes | yes | yes | A6 |
| ad58-5784-2-1 232502 | yes | yes | yes | A8 |
| ad58-5898-10-1 237143 | yes | yes | yes | C7 |
| pDAS000037 | | | | |
| lf31-6139-2-3 234576 | yes | yes | yes | A5 |
| bm56-6315-1-1 234703 | yes | yes | yes | Genomic Repeat |
| ad58-6372-1-1 240653 | yes | yes | yes | A/C8 |
| ad58-6620-4-1 242268 | yes | yes | yes | C1 |
| ad58-6620-17-1 242293 | yes | yes | yes | A/C 3 or 8 |

TABLE 17 description of single copy ETIP containing plant from the two constructs pDAS000036 and 37, BLASTn result to a *Brassica oleracea* genome sequence data base, potential disruption of gene sequence identified through *Arabidopsis thaliana* gene comparison and predicted genome location.

| | BLASTn match to the C genome | Predicted gene disrupted | Predicted Location |
|---|---|---|---|
| pDAS000036 | | | |
| em02-5788-1-1 228688 | Left border only value e−175 | At3g30775: proline oxidase | A6 |
| ad58-5784-2-1 232502 | Left border only value e−134 | At1g50940: Electron transfer flavoprotein alpha | A8 |
| ad58-5898-10-1 237143 | Left border generated two significant matches at value 0 and e−107 | No significant match to *Arabidopsis* gene | C7 |
| pDAS000037 | | | |
| lf31-6139-2-3 234576 | Right border only value e−105 | At3g08530: Clathrin | A5 |
| bm56-6315-1-1 234703 | Both borders had large numbers of matches e value 0 | N/A | Genomic Repeat |
| ad58-6372-1-1 240653 | Left and right border value e−103 and −80 | No significant match to Arabidopsis genes | Equivocal location: subgenome A or C on linkage group 8 |
| ad58-6620-4-1 242268 | Left and right border value e−154 and e−48 | At4g27860: Vacuolar ion transporter | C1 |
| ad58-6620-17-1 242293 | Left and right border value e−167 and e−94 | Borders identified At5g20340 and At1g50930 | Equivocal location: potentially sub-genome A or C and linkage group 3 or 8 |

The homozygous events are used to produce protoplasts via the previously described method. The protoplasts are subsequently co-transformed with a Zinc Finger Nuclease that is designed to target a Zinc Finger binding site which is incorporated within the ETIP sequence and a donor plasmid which shares homology with specific regions of the ETIP. The Zinc Finger Nuclease cleaves the ETIP locus and the donor plasmid is integrated within the genome of *Brassica napus* cells via homology directed repair. As a result of the integration of the donor plasmid, the partial DS-red transgene is repaired to a full length DS-red transgene. The expression of the now fully operational DS-red transgene is used to sort protoplast cells with a FACS method. Putative transgenic plants are sorted using the FACS method described in Example 7 and the isolated protoplasts are regenerated into mature plants. The integration of the donor plasmid is confirmed within the ETIP-targeted plants using molecular confirmation methods. As such, the ETIP locus serves as a site-specific locus for gene targeted integration of a donor polynucleotide sequence.

The genomic targeting locations provide genomic locations that do not alter the plants normal phenotype. The resulting events, wherein a transgene is targeted within an ETIP present no agronomically meaningful unintended differences when the ETIP events are compared to the control plants. In addition, the protein expression levels of transgenes integrated within the ETIP locus are robustly expressed and consistent and stable across multiple genomic locations. The disclosed genomic sequences of SEQ ID NO:431 to SEQ ID NO:446 provide genomic locations within the *Brassica* genome that are targetable for the integration of gene expression cassettes comprising a transgene.

Targeting of ETIP Lines with ZFN Mediated Homologous Recombination of DS-Red

Figure 19A:
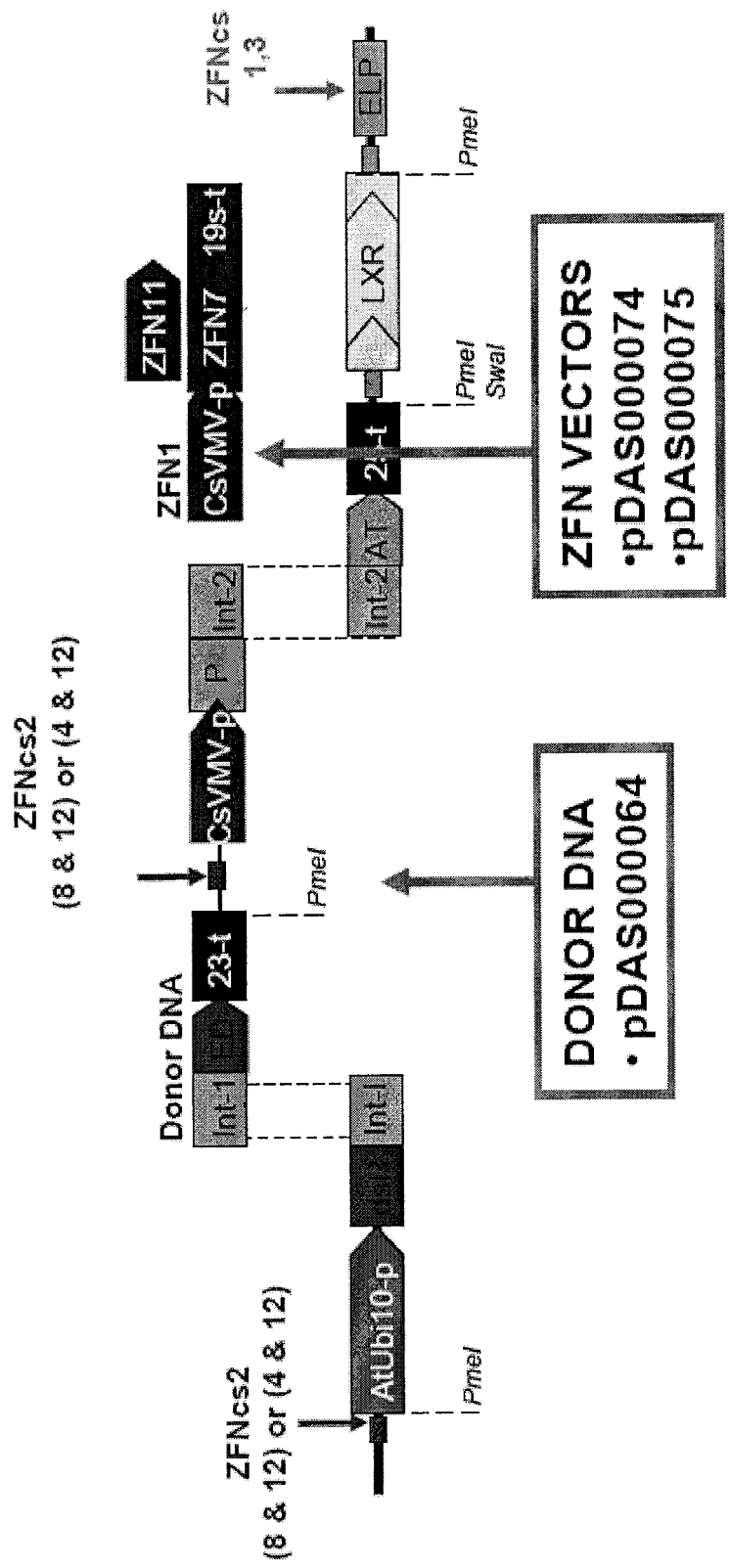
FIG. 19A-B: Illustrates the homology directed repair of the ETIP canola event which results from the double stranded DNA cleavage of the genomic locus by the Zinc Finger Nuclease (pDAS000074 or pDAS000075) and the subsequent integration of the Ds-red donor (pDAS000068, pDAS000070, or pDAS000072) into the ETIP locus of the canola chromosome. The integration of the donor into the genomic locus results in a fully functional, highly expressing Ds-red transgene.
Figure 19B:
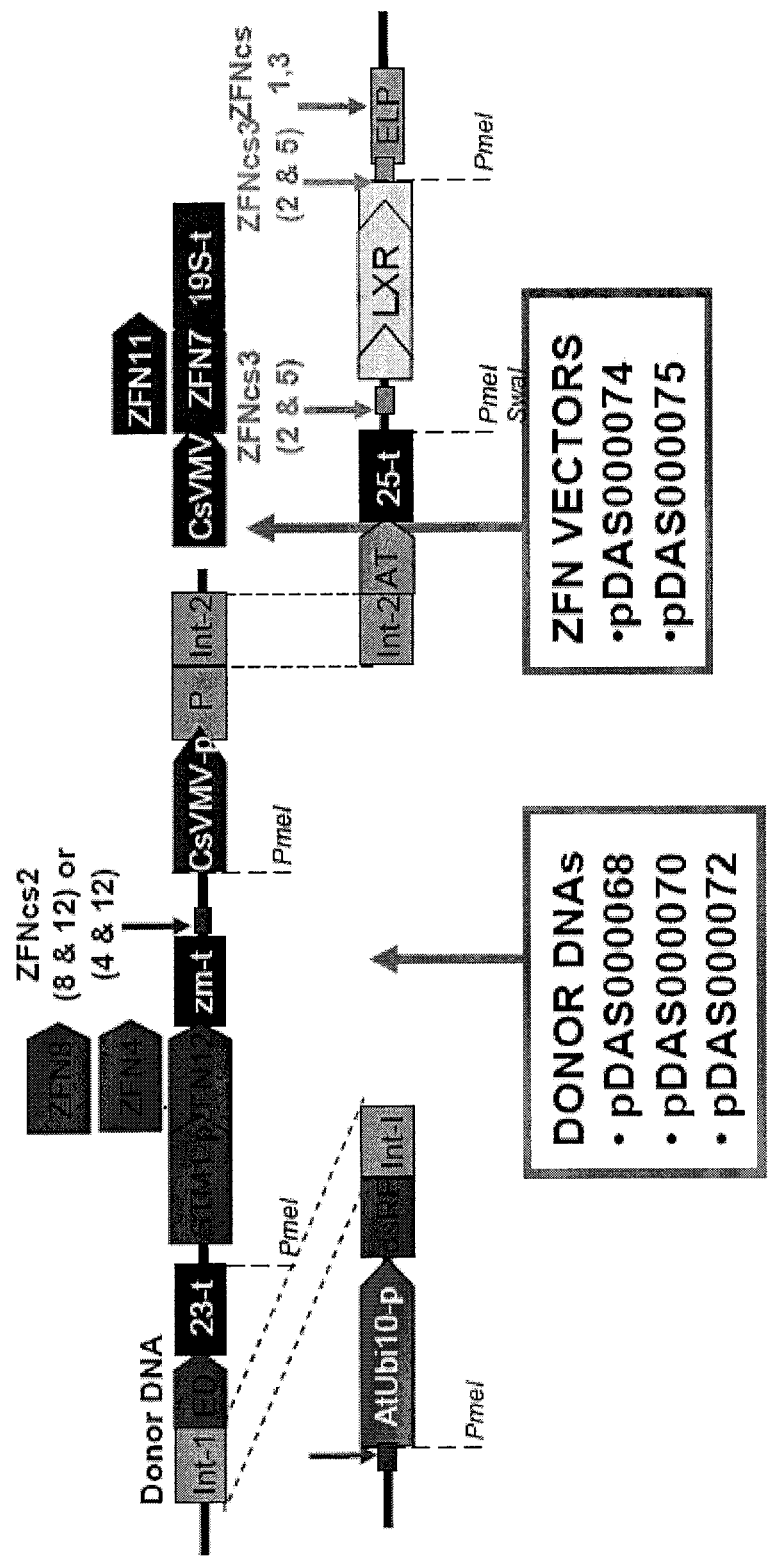
Figure 25:
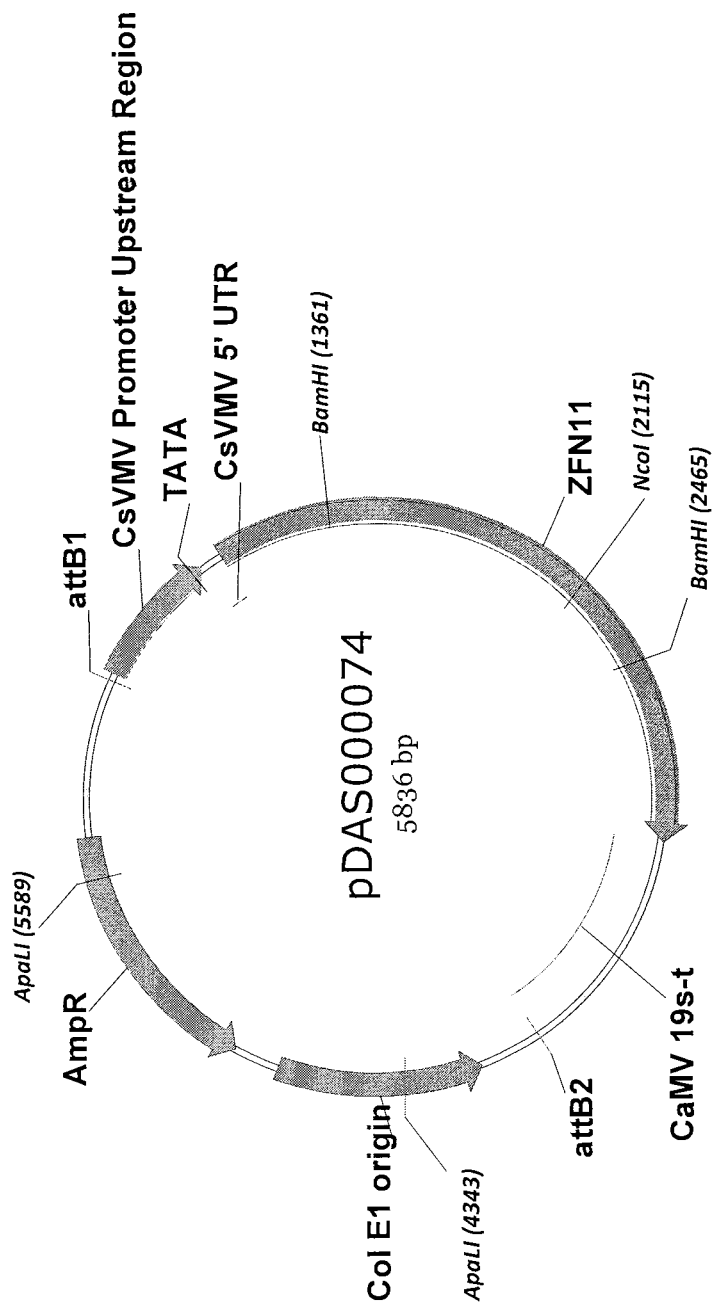
FIG. 25: Shows a plasmid map of pDAS000074.
Figure 26:
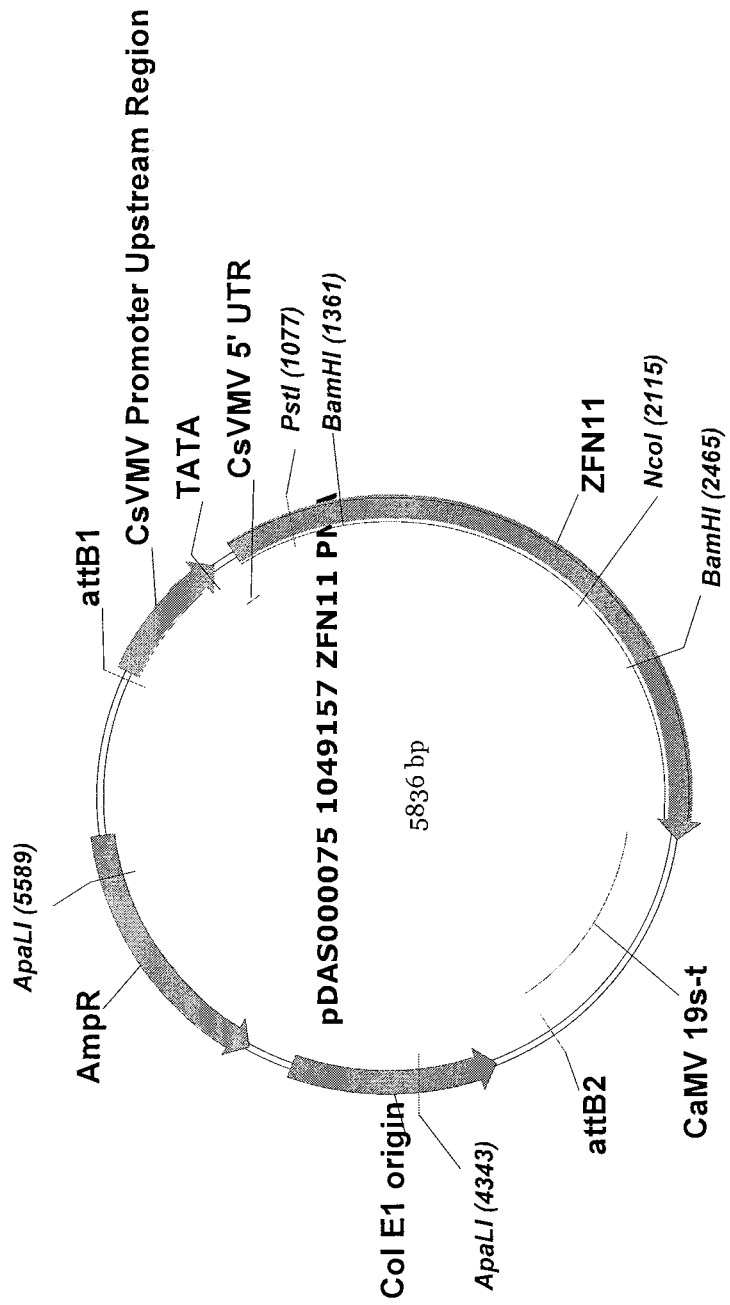
FIG. 26: Shows a plasmid map of pDAS000075.
Figure 27:
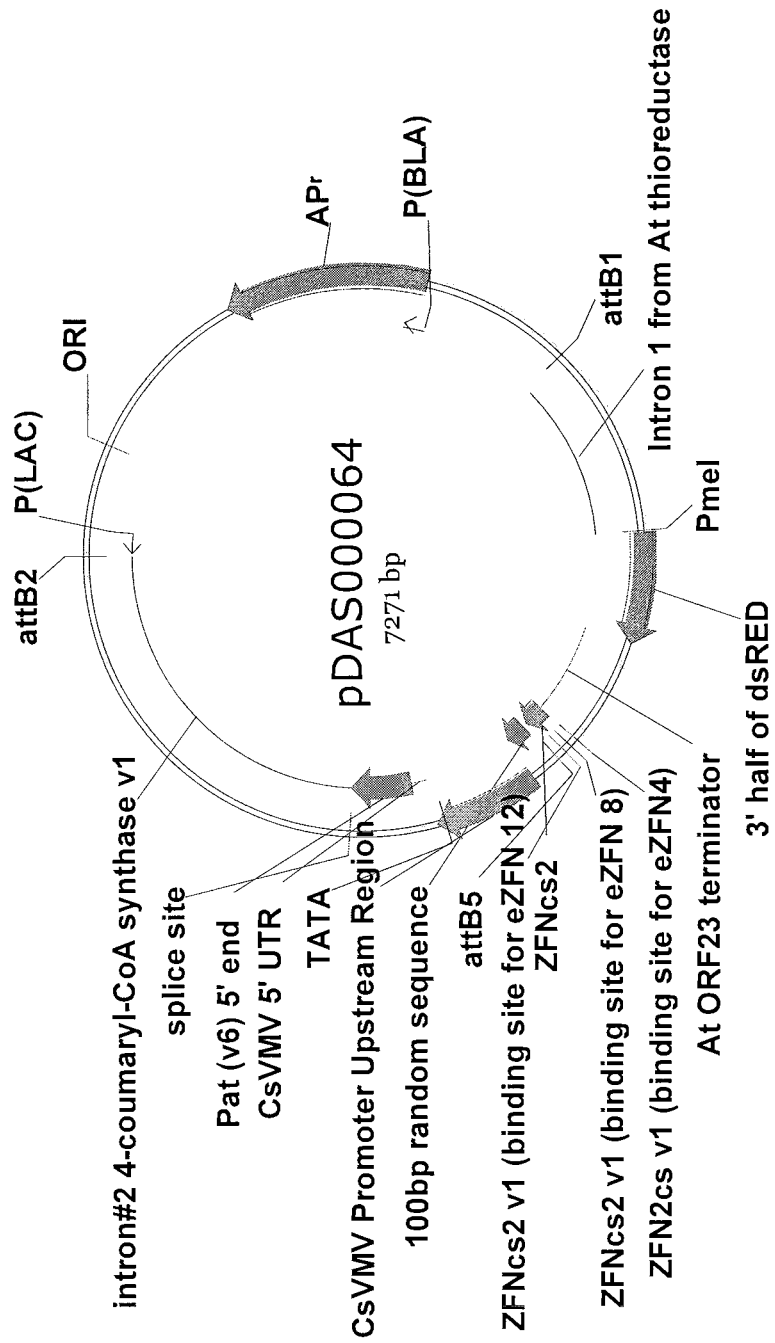
FIG. 27: Shows a plasmid map of pDAS000064.
Figure 28:
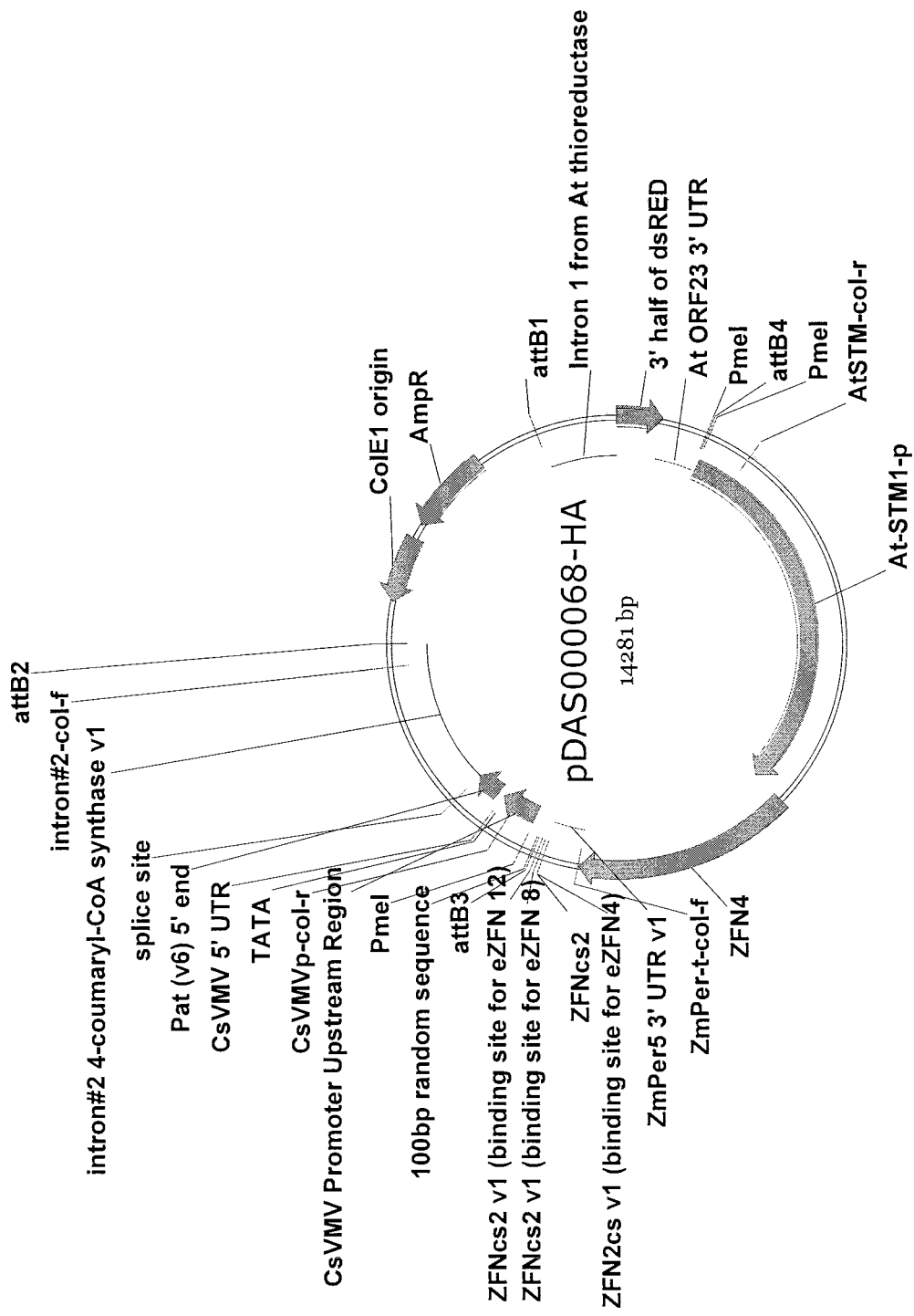
FIG. 28: Shows a plasmid map of pDAS000068.
Figure 29:
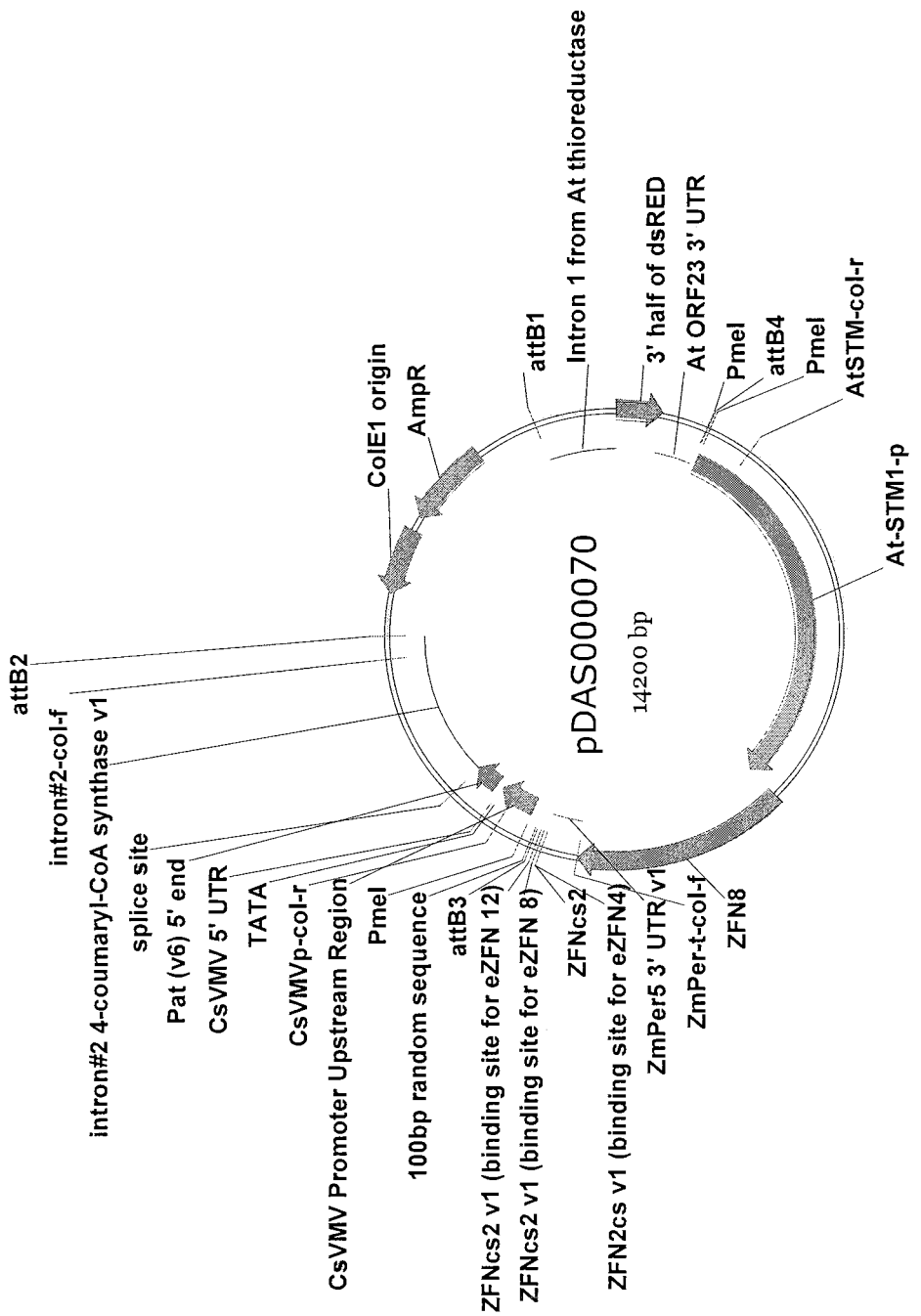
FIG. 29: Shows a plasmid map of pDAS000070.
Figure 30:
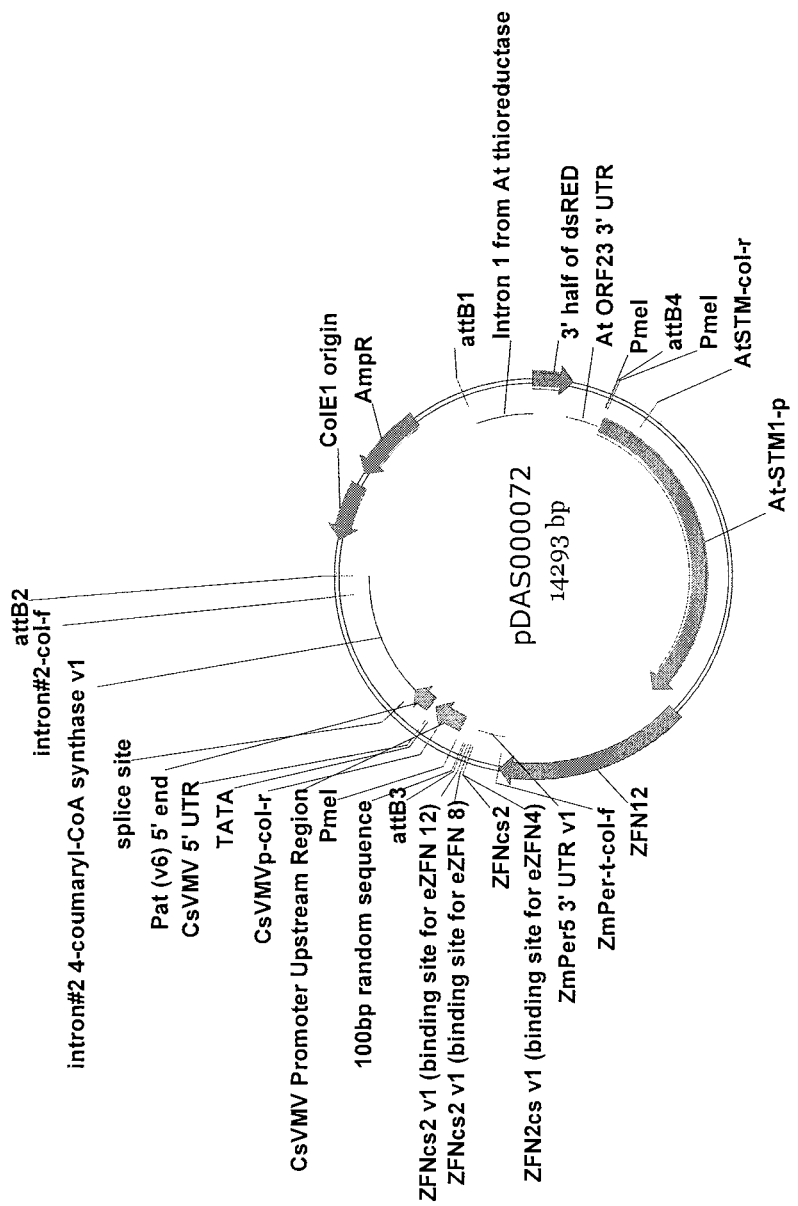
FIG. 30: Shows a plasmid map of pDAS000072.

A canola line containing the T-strand insert from pDAS000036 was obtained and confirmed via molecular characterization to contain a full length, single copy of the T-strand. This canola event was labeled as pDAS000036-88 and was used to produce protoplasts via the previously described method. The protoplasts were isolated and ~50,000 canola protoplast cells were subsequently co-transformed with a Zinc Finger Nuclease, either pDAS000074 (FIG. 25) or pDAS000075 (FIG. 26), that was designed to target the Zinc Finger binding sites incorporated within the ETIP sequence and a donor plasmid, pDAS000064, pDAS000068, pDAS000070, or pDAS000072 (FIG. 27, FIG. 28, FIG. 29, and FIG. 30, respectively), which shares homology with specific regions of the ETIP. FIG. 19 and FIG. 20 provide illustrations of the homology directed repair which results in the site-specific integration of the Ds-red transgene via Zinc Finger Nuclease mediated homologous recombination. The Zinc Finger Nuclease was designed to cleave the ETIP locus at a defined Zinc Finger binding sequence, thereby creating a double strand break within the genome. Next, the donor plasmid was integrated within the genome of *Brassica napus* protoplast cells via homology directed repair. The intron-1 and intron-2 regions of the donor plasmid share homology with the corresponding intron-1 and intron-2 regions of the ETIP locus. As a result of the integration of the donor plasmid, the partial DS-red transgene was repaired to a full length, highly expressing DS-red transgene. The expression of the fully operational DS-red transgene was used to sort protoplast cells with the above described FACS method. As such, the ETIP locus serves as a site-specific locus for targeted integration of a donor polynucleotide sequence. Finally, the isolated protoplasts can be sorted and regenerated into mature plants. The integration of the donor plasmid can be confirmed within the ETIP-targeted plants using molecular confirmation methods.

The donor plasmid DNA and ZFN plasmid DNA were mixed at various concentrations and used to transfect the canola protoplast cells containing Event pDAS000036-88, and the transgenic protoplast cells were sorted using the FACS transfection that was previously described. Table 18 describes the various transfection experiments and the DNA concentrations which were used for the transfection of the canola protoplasts containing Event pDAS000036-88. The ZFN and donor plasmid DNA was isolated and prepared for the transfections via the previously described methods.

TABLE 18

Donor plasmids and Zinc Finger Nuclease constructs used for the ETIP targeting experiments. The DNA concentrations were used at the indicated ratio of donor to Zinc Finger Nuclease, for a total concentration of 30 micrograms of plasmid DNA per transfection.

| REACTIONS | PLASMIDS | DONOR PLASMID DNA (µg) | ZFN PLASMID DNA (µg) | TOTAL (µg) |
|---|---|---|---|---|
| 1 | pDAS000074 | — | 30 | 30 |
| 2 | pDAS000075 | — | 30 | 30 |
| 3 | pDAS000064 + pDAS000074 | 26 | 4 | 30 |
| 4 | pDAS000064 + pDAS000075 | 26 | 4 | 30 |
| 5 | pDAS000068 + pDAS000074 | 28 | 2 | 30 |
| 6 | pDAS000068 + pDAS000075 | 28 | 2 | 30 |
| 7 | pDAS000070 + pDAS000074 | 28 | 2 | 30 |
| 8 | pDAS000070 + pDAS000075 | 28 | 2 | 30 |
| 9 | pDAS000072 + pDAS000074 | 28 | 2 | 30 |
| 10 | pDAS000072 + pDAS000075 | 28 | 2 | 30 |
| 11 | pDAS000064 | 30 | — | 30 |
| 12 | pDAS000068 | 30 | — | 30 |
| 13 | pDAS000070 | 30 | — | 30 |
| 14 | pDAS000072 | 30 | — | 30 |

After the transfection experiments were completed the protoplasts were incubated at room temperature for 48 hours and sorted using the above described FACS protocol. Each experiment was sorted independently and Zinc Finger-mediated introgression of a transgene was confirmed via identification of individual events which expressed the DS-red transgene. FIGS. 21-24 show the results of the FACS sorting. As the results depicted in the graphs indicate, multiple events were produced which contained an intact fully integrated DS-red transgene. These multiple Ds-Red events were the result of Zinc Finger Nuclease mediated integration of the donor DNA construct within the ETIP genomic locus. This site-specific integration resulted in a highly expressing, complete copy of the Ds-Red transgene. The frequency of the Ds-Red transgene expression ranged from about 0.03-0.07% of the total canola protoplast cells (~50,000). However, the frequency of transfection efficiency for the Zinc Finger Nuclease mediated integration of the donor DNA construct within the ETIP genomic locus was much higher and ranged from about 0.07-0.64%.

Figure 21:
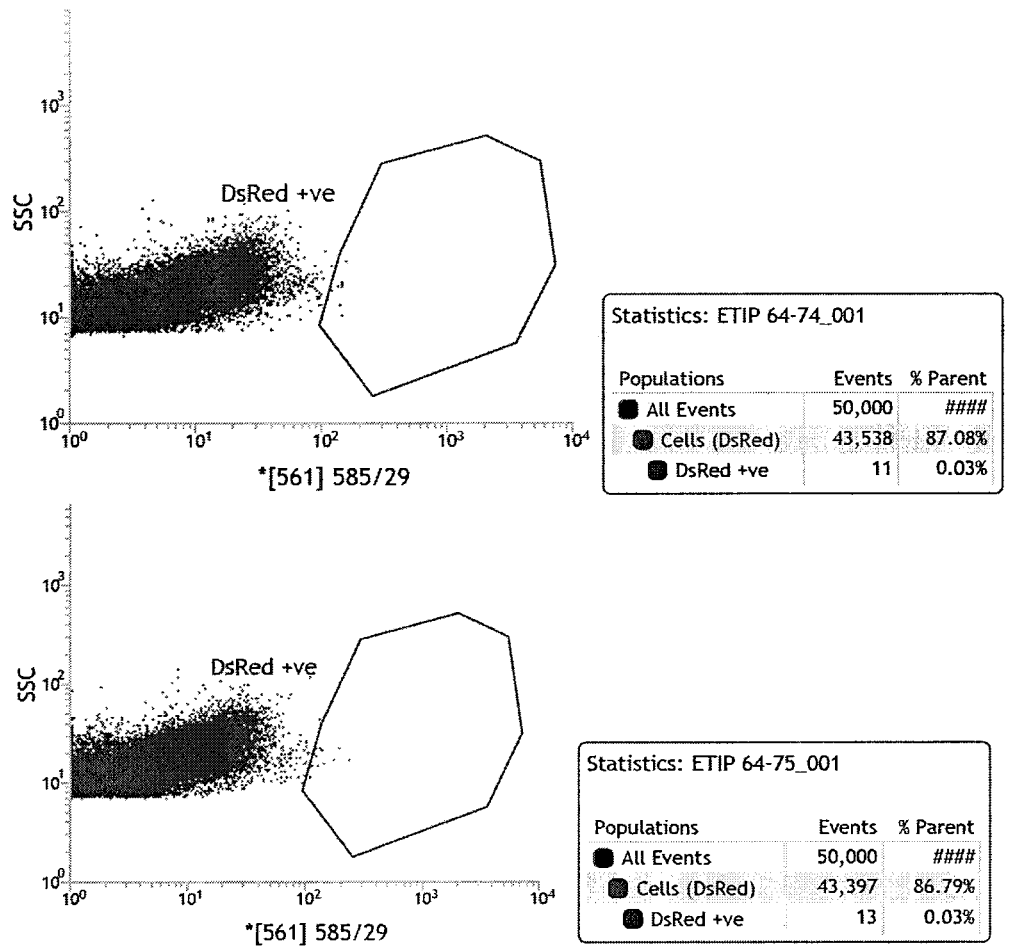
FIG. 21: Shows the FACS sorting of canola protoplasts and the calculated transfection efficiency of canola ETIP protoplast events which were transfected with pDAS000064/pDAS000074 (top graph) and pDAS000064/pDAS000075 (bottom graph).

FIG. 21 shows the results of the transfections in which the donor plasmid and ZFN plasmid were co-transformed. The top graph, wherein donor, pDAS000064, and the Zinc Finger Nuclease, pDAS000074, were co-transformed at a ratio of 26 µg to 4 µg of plasmid DNA resulted in the Zinc Finger Nuclease mediated integration of the donor DNA construct within the ETIP genomic locus at a recombination frequency of about 0.03% of the ~50,000 canola protoplast cells. In actuality, the recombination frequency is much higher. Of the ~50,000 canola protoplast cells which were provided during the transfection experiment, only about 10-30% of these canola protoplast cells are actually transformed. As such, the actual Zinc Finger Nuclease mediated integration of the donor DNA construct within the ETIP genomic locus transfection efficiency ranges from about 0.22-0.07%. Similarly the bottom graph, wherein donor, pDAS000064, and the Zinc Finger Nuclease, pDAS000075, were co-transformed at a ratio of 26 µg to 4 µg of plasmid DNA resulted in the Zinc Finger Nuclease mediated integration of the donor DNA construct within the ETIP genomic locus at a recombination frequency of about 0.03% of the ~50,000 canola protoplast cells. In actuality, the recombination frequency is much higher. Of the ~50,000 canola protoplast cells which were provided during the transfection experiment, only about 10-30% of these cells are actually transfected. As such, the actual Zinc Finger Nuclease mediated integration of the donor DNA construct within the ETIP genomic locus transfection efficiency ranges from about 0.26-0.08%. The results of the zinc finger mediated homology directed repair are significantly greater than the negative control experiments, wherein only one protoplast of ~50,000 was identified to have red flouresence, thereby resulting in a recombination frequency of 0.00%, as shown in FIG. 20.

FIG. 22 shows the results of the transfections in which the donor plasmid and ZFN plasmid were co-transformed. The top graph, wherein donor, pDAS000068, and the Zinc Finger Nuclease, pDAS000074, were co-transformed at a ratio of 28 µg to 2 µg of plasmid DNA resulted in the Zinc Finger Nuclease mediated integration of the donor DNA construct within the ETIP genomic locus at a recombination frequency of about 0.03% of the ~50,000 canola protoplast cells. In actuality, the recombination frequency is much higher. Of the ~50,000 canola protoplast cells which were provided during the transfection experiment, only about 10-30% of these canola protoplast cells are actually transformed. As such, the actual Zinc Finger Nuclease mediated integration of the donor DNA construct within the ETIP genomic locus transfection efficiency ranges from about 0.22-0.07%. Similarly the bottom graph, wherein donor, pDAS000068, and the Zinc Finger Nuclease, pDAS000075, were co-transformed at a ratio of 28 µg to 2 µg of plasmid DNA resulted in the Zinc Finger Nuclease mediated integration of the donor DNA construct within the ETIP genomic locus at a recombination frequency of about 0.04% of the ~50,000 canola protoplast cells. In actuality, the recombination frequency is much higher. Of the ~50,000 canola protoplast cells which were provided during the transfection experiment, only about 10-30% of these cells are actually transfected. As such, the actual Zinc Finger Nuclease mediated integration of the donor DNA construct within the ETIP genomic locus transfection efficiency ranges from about 0.38-0.12%. The results of the zinc finger mediated homology directed repair are significantly greater than the negative control experiments, wherein only one protoplast of ~50,000 was identified to have red flouresence, thereby resulting in a recombination frequency of 0.00%, as shown in FIG. 20.

Figure 23:
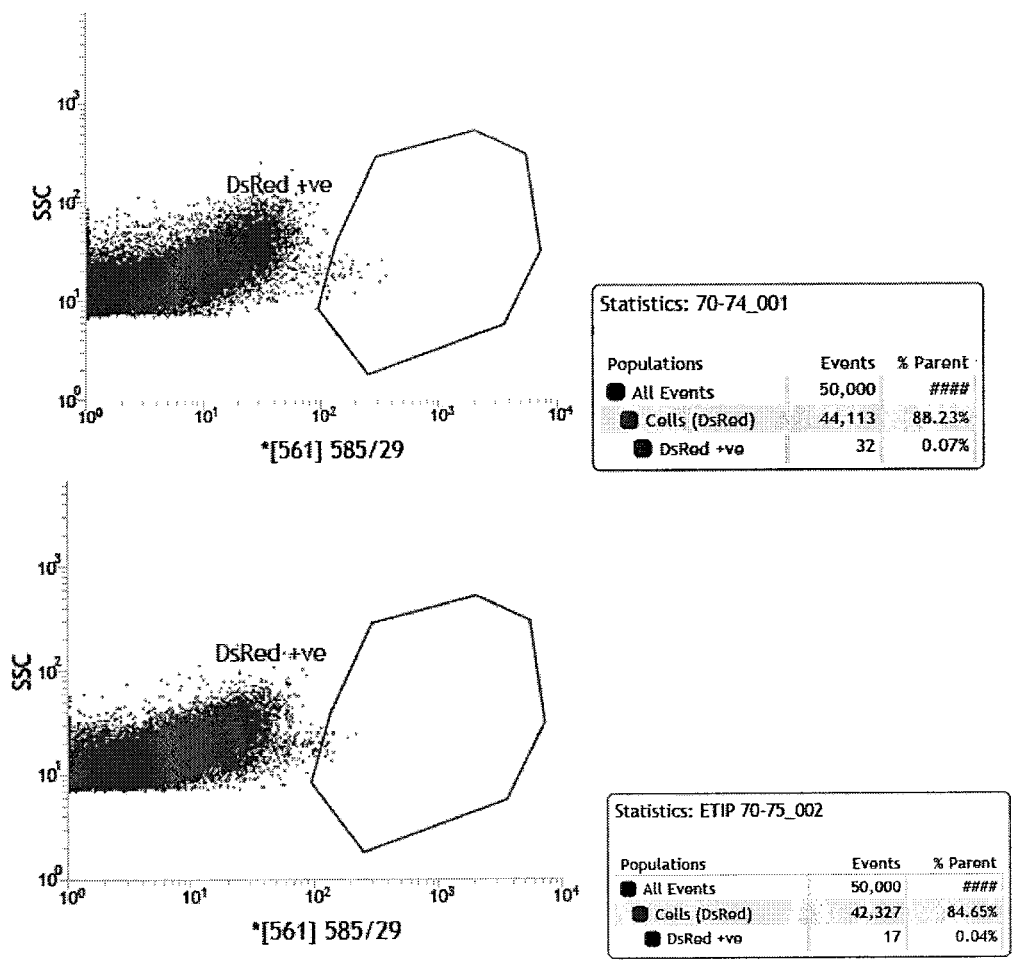
FIG. 23: Shows the FACS sorting of canola protoplasts and the calculated transfection efficiency of canola ETIP protoplast events which were transformed with pDAS000070/pDAS000074 (top graph) and pDAS000070/pDAS000075 (bottom graph).

FIG. 23 shows the results of the transfections in which the donor plasmid and ZFN plasmid were co-transformed. The top graph, wherein donor, pDAS000070, and the Zinc Finger Nuclease, pDAS000074, were co-transformed at a ratio of 28 µg to 2 µg of plasmid DNA resulted in the Zinc Finger Nuclease mediated integration of the donor DNA construct within the ETIP genomic locus at a recombination frequency of about 0.07% of the ~50,000 canola protoplast cells. In actuality, the recombination frequency is much higher. Of the ~50,000 canola protoplast cells which were provided during the transfection experiment, only about 10-30% of these canola protoplast cells are actually transformed. As such, the actual Zinc Finger Nuclease mediated integration of the donor DNA construct within the ETIP genomic locus transfection efficiency ranges from about 0.64-0.21%. Similarly the bottom graph, wherein donor, pDAS000070, and the Zinc Finger Nuclease, pDAS000075, were co-transformed at a ratio of 28 µg to 2 µg is of plasmid DNA resulted in the Zinc Finger Nuclease mediated integration of the donor DNA construct within the ETIP genomic locus at a recombination frequency of about 0.04% of the ~50,000 canola protoplast cells. In actuality, the recombination frequency is much higher. Of the ~50,000 canola protoplast cells which were provided during the transfection experiment, only about 10-30% of these cells are actually transfected. As such, the actual Zinc Finger Nuclease mediated integration of the donor DNA construct within the ETIP genomic locus transfection efficiency ranges from about 0.34-0.11%. The results of the zinc finger mediated homology directed repair are significantly greater than the negative control experiments, wherein only one protoplast of ~50,000 was identified to have red flouresence, thereby resulting in a recombination frequency of 0.00%, as shown in FIG. 20.

Figure 24:
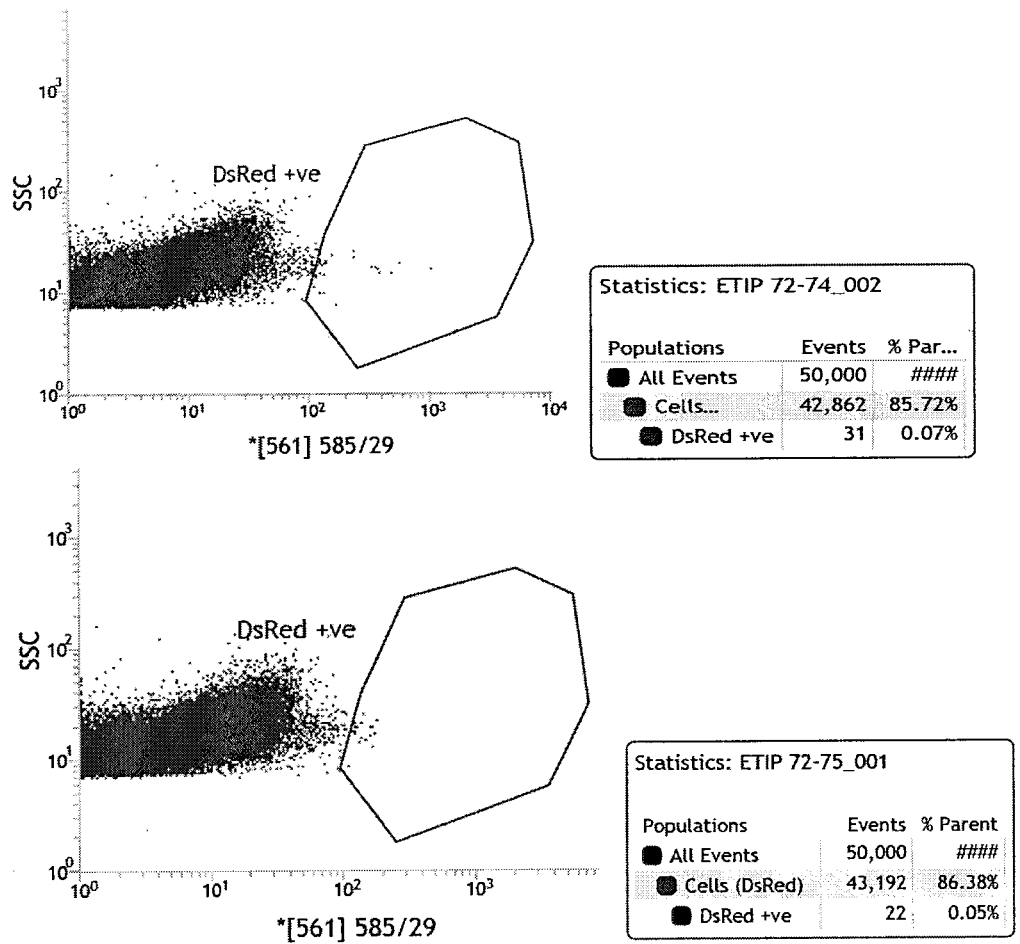
FIG. 24: Shows the FACS sorting of canola protoplasts and the calculated transfection efficiency of canola ETIP protoplast events which were transformed with pDAS000072/pDAS000074 (top graph) and pDAS000072/pDAS000075 (bottom graph).

FIG. 24 shows the results of the transfections in which the donor plasmid and ZFN plasmid were co-transformed. The top graph, wherein donor, pDAS000072, and the Zinc Finger Nuclease, pDAS000074, were co-transformed at a ratio of 28 µg to 2 µg of plasmid DNA resulted in the Zinc Finger Nuclease mediated integration of the donor DNA construct within the ETIP genomic locus at a recombination frequency of about 0.07% of the ~50,000 canola protoplast cells. In actuality, the recombination frequency is much higher. Of the ~50,000 canola protoplast cells which were provided during the transfection experiment, only about 10-30% of these canola protoplast cells are actually transformed. As such, the actual Zinc Finger Nuclease mediated integration of the donor DNA construct within the ETIP genomic locus transfection efficiency ranges from about 0.62-0.20%. Similarly the bottom graph, wherein donor, pDAS000072, and the Zinc Finger Nuclease, pDAS000075, were co-transformed at a ratio of 28 µg to 2 µg of plasmid DNA resulted in the Zinc Finger Nuclease mediated integration of the donor DNA construct within the ETIP genomic locus at a recombination frequency of about 0.05% of the ~50,000 canola protoplast cells. In actuality, the recombination frequency is much higher. Of the ~50,000 canola protoplast cells which were provided during the transfection experiment, only about 10-30% of these cells are actually transfected. As such, the actual Zinc Finger Nuclease mediated integration of the donor DNA construct within the ETIP genomic locus transfection efficiency ranges from about 0.44-0.14%. The results of the zinc finger mediated homology directed repair are significantly greater than the negative control experiments, wherein only one protoplast of ~50,000 was identified to have red flouresence, thereby resulting in a recombination frequency of 0.00%, as shown in FIG. 20.

Selected explants were transferred and cultured upon regeneration media containing phophothrinocin. After the culturing period the surviving explants were transferred to elongation medium and root induction medium for culturing and plant development. Whole plants that consisted of developed root and shoot structures were transferred into soil and further propagated in the greenhouse. The tissue culture process utilized media and culture conditions as previously described above. The results of plants produced from the tissue culturing process are shown in Table 19 below.

TABLE 19

Results of tissue culturing process.

| Construct | No. of explants transferred to regeneration media: B2-2 PPT | No. of explants surviving in regeneration media: B2-2 PPT | No. of shoots surviving in shoot elongation media: SEM-2 PPT | No. of shoots surviving in RIM-2 PPT | No. of rooted plants transferred to soil |
|---|---|---|---|---|---|
| pDAS000064 + pDAS000074-I | 4021 | 36 | 74 | 1 | — |
| pDAS000064 + pDAS000074-II | 1300 | 90 | 13 | 1 | 1 |
| pDAS000064 + pDAS000074-III | 1760 | 15 | 36 | 2 | — |
| pDAS000068 + pDAS000074-I | 1700 | 100 | 4 | 8 | 2 |
| pDAS000068 + pDAS000074-II | 1630 | — | 29 | 15 | — |
| pDAS000068 + pDAS000074-III | 2523 | 30 | 11 | 1 | — |
| pDAS000070 + pDAS000074-I | 2084 | 10 | 34 | 1 | — |
| pDAS000070 + pDAS000074-II | 4151 | — | 88 | 7 | — |
| pDAS000070 + pDAS000074-III | 1480 | 415 | 14 | 0 | — |
| pDAS000072 + pDAS000074-I | 1980 | 7 | 19 | 16 | — |
| pDAS000072 + pDAS000074-II | 1050 | 0 | 0 | 0 | — |
| pDAS000072 + pDAS000074-III | 1200 | — | 2 | 0 | — |
| pDAS000064 + pDAS000074-I | 556 | — | 8 | 1 | — |
| pDAS000064 + pDAS000074-II | 581 | 13 | 7 | — | — |
| pDAS000064 + pDAS000074-III | 1160 | 90 | 17 | 1 | — |
| pDAS000068 + pDAS000074-I | 516 | 0 | 13 | — | — |
| pDAS000068 + pDAS000074-II | 1725 | 55 | 19 | 3 | — |
| pDAS000068 + pDAS000074-III | 930 | 57 | 0 | — | — |
| pDAS000070 + pDAS000074-I | 600 | 8 | 3 | — | — |
| pDAS000070 + pDAS000074-II | 4410 | 1410 | 360 | 3 | — |
| pDAS000070 + pDAS000074-III | 2350 | 108 | 51 | 8 | — |
| pDAS000072 + pDAS000074-I | 1660 | 10 | 19 | 3 | 1 |
| pDAS000072 + pDAS000074-II | 175 | — | 13 | — | — |
| pDAS000072 + pDAS000074-III | 250 | 9 | 2 | — | — |
| pDAS000064 + pDAS000074 | $3 \times 10^5$ | — | — | — | — |
| pDAS000068 + pDAS000074 | $1 \times 10^5$ | 114 | 12 | 1 | — |
| pDAS000070 + pDAS000074 | $3 \times 10^5$ | 478 | 391 | — | — |
| pDAS000072 + pDAS000074 | $3 \times 10^5$ | 81 | 12 | — | — |
| pDAS000064 + pDAS000074 | $3 \times 10^5$ | 38 | 7 | — | — |
| pDAS000068 + pDAS000074 | $3 \times 10^5$ | — | — | — | — |
| pDAS000070 + pDAS000074 | $1 \times 10^5$ | 80 | 7 | 1 | — |
| pDAS000072 + pDAS000074 | $3 \times 10^5$ | 7 | 3 | — | — |

Molecular Confirmation of FAD2A Integration of ETIPS in Canola

Genomic DNA was extracted from leaf tissue of all putative transgenic plants using a DNeasy Plant Mini Kit™ (Qiagen) following the manufacturer's instructions, with the exception that tissue was eluted in 80 µl of AE buffer. Thirty milligrams of young leaf tissue from regenerated plants was snap frozen in liquid nitrogen before being ground to a powder.

Molecular characterization of the FAD2A locus was performed using three independent assays. Assays were designed and optimized using the following controls; characterized transgenic events comprising a single randomly integrated transgene, characterized transgenic event with five randomly integrated transgenes, wildtype canola c.v. DH12075 plants and non-template control reactions. The results from the three following molecular analyses are considered together in order to provide evidence for integration of the ETIP at FAD2A via HDR.

Identifying Transgene Integration by Real-Time Polymerase Chain Reaction

Figure 31:
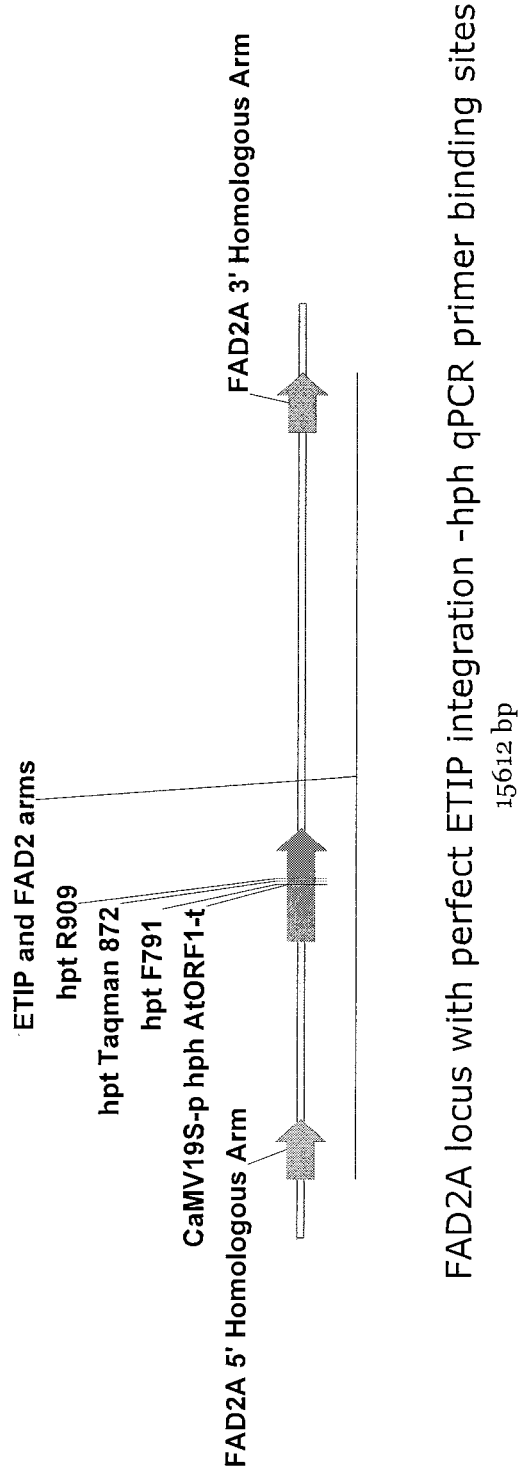
FIG. 31: Is a schematic showing binding sites of transgene target primers and probe for transgene copy number estimation assay.

Four replicates of each plant were analyzed using primers specific to the hph (also described as hpt) target gene (SEQ ID NO:447, hpt F791 5' CTTACATGCTTAGGATCG-GACTTG 3; SEQ ID NO:448, hpt R909 5' AGTTCCAG-CACCAGATCTAACG 3'; SEQ ID NO:449, hpt Taqman 872 5' CCCTGAGCCCAAGCAGCATCATCG 3' FAM) (FIG. 31) and reference gene encoding High Mobility Group protein I/Y (HMG I/Y) (SEQ ID NO:450, F 5' CGGA-GAGGGCGTGGAAGG 3'; SEQ ID NO:451, R 5' TTC-GATTTGCTACAGCGTCAAC 3'; SEQ ID NO:452, Probe 5' AGGCACCATCGCAGGCTTCGCT 3' HEX). The reactions were amplified using the following conditions: 95° C. for 10 minutes followed by 40 cycles of 95° C. for 30 seconds, 60° C. for 1 minute, with amplification data being captured at the end of each annealing step. Copy number was calculated using the ΔCq method, where ΔCq=Cq(target gene)−Cq(reference gene). Livak, K. J. and T. D. Schmittgen, *Analysis of relative gene expression data using real-time quantitative PCR and the 2(−Delta Delta C(T)) Method*. Methods, 2001. 25(4): p. 402-8. Plants with amplification of hph and HMG I/Y and a copy number of 0.5 or more were considered transgenic, while plants with a copy number of ≥0.5 and ≤1.2 were scored as putatively single copy. Amplification was performed on a BioRad CFX96 Touch™ Real-Time PCR Detection System with FastStart Universal Probe Master (ROX), (Roche, Basel, Switzerland).

Detection of Disrupted FAD2A ZFN Site

Figure 32:
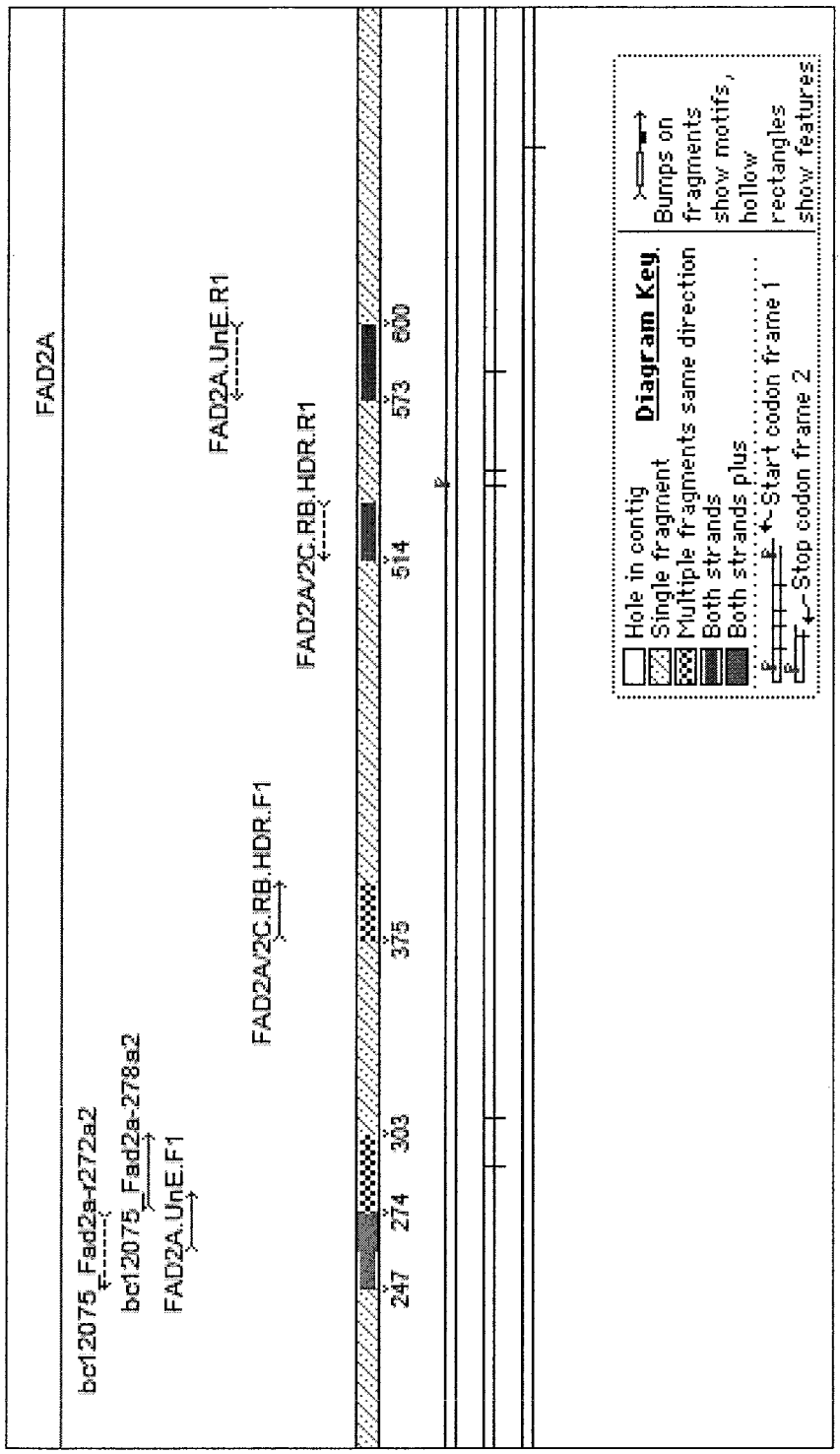
FIG. 32: Shows a Sequencher file showing FAD2A ZFN DNA recognition domain (bc12075_Fad2a-r272a2 and bc12075_Fad2a-278a2), and binding sites of ZFN specific primers (FAD2A.UnE.F1 and FAD2A.UnE.R1) and endogenous primers (FAD2A/2C.RB.UnE.F1 and FAD2A/2C.RB.UnE.R1).

Each plant was analysed for presence or absence of amplification of endogenous target in the disrupted locus test, which is a dominant assay. The assay is a SYBR® Green I qPCR assay and in singleplex, but with each reaction run simultaneously on the same PCR plate, targets an endogenous locus (FAD2A/2C.RB.UnE.F1, SEQ ID NO:453, 5' CTTCCACTCCTTCCTCCTCGT*C 3' and FAD2A/2C.RB.UnE.R1, 5' SEQ ID NO:454, GCGTCCCAAAGGGTTGTTGA*G 3') and the ZFN locus (locus at which the ZFN pDAB104010 binds and cuts the genome) (FAD2A.UnE.F1, SEQ ID NO:455, 5' TCTCTACTGGGCCTGCCAGGG*C 3' and FAD2A.UnE.R1, SEQ ID NO:456, 5' CCCCGAGACGTTGAAGGCTAAGTACAA*A 3') (FIG. 32). Both primer pairs were amplified using the following conditions: 98° C. for 30 seconds followed by 35 cycles of (98° C. for 10 seconds, 65° C. for 20 seconds, 72° C. for 90 seconds) then followed by 95° C. for 10 seconds then a melt analysis from 50° C. to 95° C. with 0.5° C. increments for 0.05 seconds and a plate read at each increment. The reaction conditions are listed in Table 20.

TABLE 20

Single reaction reagent components and concentrations for PCR amplification.

| Reaction Components | Volume (μl) |
| --- | --- |
| 10 mM dNTP | 0.40 |
| 5X Phusion HF Buffer | 4.00 |
| Phusion Hot Start II High-Fidelity DNA Polymerase (2U/μl) (Thermo Scientific) | 0.25 |
| Forward Primer 10 μM | 0.40 |
| Reverse Primer 10 μM | 0.40 |
| 1:10000 dilution of SYBR Green I dye (Invitrogen) | 1.00 |
| Molecular Biology Grade H$_2$O | 11.55 |
| Genomic DNA template (~20 ng/μl) | 2.00 |
| Total Volume | 20.00 |

Plants that had amplification of the endogenous target but no amplification of the ZFN target, were scored as positive for the disrupted locus test and were considered to have a disrupted ZFN locus. This assay was considered to be positive when the ZFN binding site on both alleles at the FAD2A locus have been disrupted.

PCR Detection of Transgene Integration at FAD2A Via Homology Directed Repair

Figure 33:
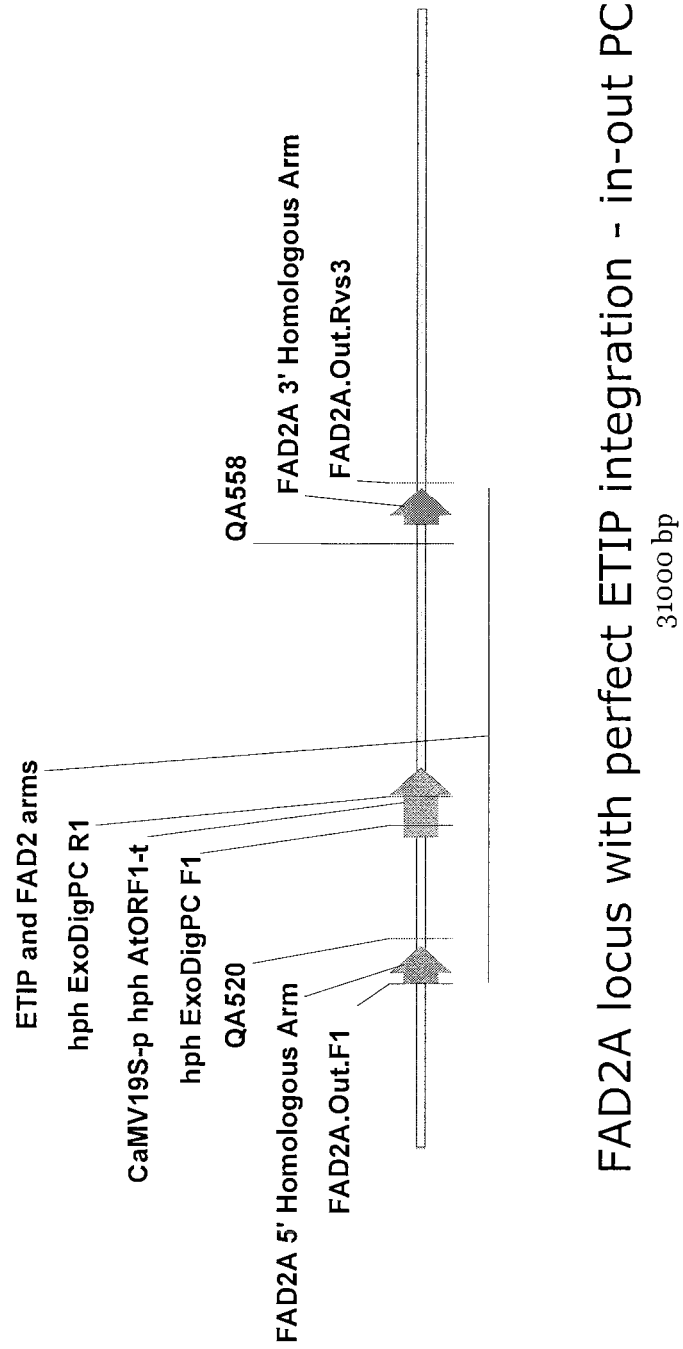
FIG. 33: Shows a schematic showing binding sites of endogenous and transgene target primers used in the detection of transgene integration at FAD2A via perfect HDR.

Each putative plant transformant was analysed using endpoint with PCR primers designed to amplify the transgene target hph (hph_ExoDigPC_F1, SEQ ID NO:457, 5' TTGCGCTGACGGATTCTACAAGGA 3' and hph_ExoDigPC_R1, SEQ ID NO:458, 5' TCCATCAGTCCAAACAGCAGCAGA 3'), the FAD2A endogenous locus (FAD2A.Out.F1, SEQ ID NO:459, 5' CATAGCAGTCTCACGTCCTGGT*C 3' and FAD2A.Out.Rvs3, SEQ ID NO:460, 5' GGAAGCTAAGCCATTACACTGTTCA*G 3'), the region spanning the 5' end of any transgene inserted into the FAD2A locus via HDR, upstream of the transgene into the FAD2 A locus (FAD2A.Out.F1, SEQ ID NO:461, 5' CATAGCAGTCTCACGTCCTGGT*C 3' and QA520, SEQ ID NO:462, 5' CCTGATCCGTTGACCTGCAG 3') and the region spanning the 3' end of any transgene inserted into the FAD2A locus via HDR, downstream of the transgene into the FAD2 A locus (QA558, SEQ ID NO:463, 5' GTGTGAGGTGGCTAGGCATC 3' and FAD2A.Out.Rvs3, SEQ ID NO:464, 5' GGAAGCTAAGCCATTACACTGTTCA*G 3') (FIG. 33). All primer pairs were amplified using the following conditions 98° C. for 30 seconds followed by 35 cycles of (98° C. for 10 seconds, 65° C. for 20 seconds, 72° C. for 90 seconds). Reaction reagent conditions are as described in Table 21.

TABLE 21

Single reaction reagent components and concentrations for PCR amplification.

| Reaction Components | Volume (μl) |
| --- | --- |
| 5x Phusion HF Buffer | 6.00 |
| 10 mM dNTPs | 0.60 |
| Forward Primer 10 μM | 0.60 |
| Reverse Primer 10 μM | 0.60 |
| Phusion Hot Start II High-Fidelity DNA Polymerase (2 U/μl) (Thermo Scientific) | 0.25 |
| Molecular Biology Grade H$_2$O | 19.95 |
| Genomic DNA template (~20 ng/μl) | 2.00 |
| Total Volume | 30.0 |

Amplification of the 5' transgene-genome flanking target and/or amplification of the 3' transgene-genome flanking target indicated a putative insertion event. It must be noted that due to the approximately 1,000 bp FAD2A homology arms in the pDAS000130 cassette (comprising polynucleotide sequences with 100% sequence identity to the FAD2A regions immediately upstream and downstream of the ZFN cut site), the PCR reactions were subject to false positive PCR product amplification due to PCR chimerism arising from amplification of off-target ETIP integration events. Amplification of the hph target confirmed transgene integration had occurred. Amplification of the FAD2A target suggests that the FAD2A locus is intact or contains only a partial insertion. Due to the size of the ETIP (11,462 bp for the ETIP cassettes or 13,472 bp including the FAD2A homologous arms and the ETIP cassettes) it is expected that the FAD2A primers would not amplify a product when an intact ETIP is integrated into the FAD2A locus.

Southern Detection of FAD2A Editing

Figure 34:
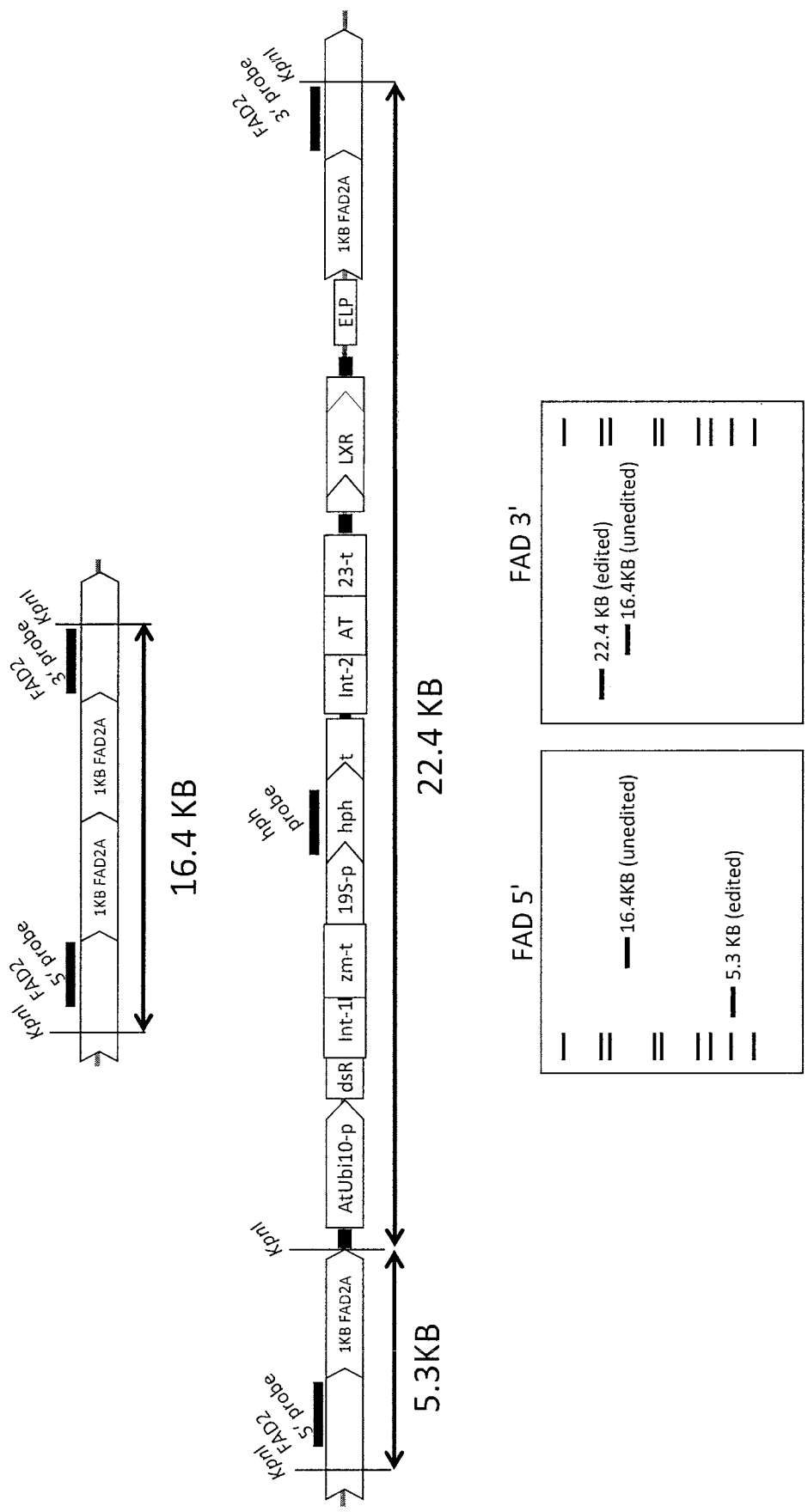
FIG. 34: Is a schematic showing where Kpn1 restriction endonuclease sites would occur in a perfectly edited FAD2A locus, and where FAD2a 5', hph and FAD2A 3' Southern probes bind.

Plants that had amplification of either a 5' genome-transgene flanking target product and/or amplification of a 3' transgene-genome flanking target, or no amplification of the ZFN locus target, or both, were subject to Southern analysis for detection of transgene integration at the FAD2A locus. Genomic DNA was purified from 5 g of leaf tissue using a modified CTAB method (Maguire, T. L., G. G. Collins, and M. Sedgley *A modified CTAB DNA extraction procedure for plants belonging to the family proteaceae.* Plant Molecular Biology Reporter, 1994. 12(2): p. 106-109). Next, 12 μg of genomic DNA was digested with Kpn1-HF (New England BioLabs) and digestion fragments were separated by electrophoresis on a 0.8% agarose gel before transfer to membrane using a standard Southern blotting protocol. Primers to FAD2A 5' target region (F, SEQ ID NO:465, 5' AGAGAGGAGACAGAGAGAGAGT 3' and R, SEQ ID NO:466, 5' AGACAGCATCAAGATTTCACACA 3'), FAD2A 3' target region (F, SEQ ID NO:467, 5' CAACGGCGAGCGTAATCTTAG 3' and R, SEQ ID NO:468, 5' GTTCCCTGGAATTGCTGATAGG 3') and hph (F, SEQ ID NO:469, 5' TGTTGGTGGAAGAGGATACG 3' and R, SEQ ID NO:470, 5' ATCAGCAGCAGCGATAGC 3') were used to generate probes to detect the presence of the ETIP within the FAD2A locus using the DIG Easy Hyb System® (Roche, South San Francisco, Calif.) following the manufacturer's instructions (FIG. 34). Hybridization was performed at 42° C. for FAD2A 5' region, 45° C. for FAD2A 3' region and 42° C. for detection of hph.

Membrane-bound genomic DNA was probed in a specific order; firstly FAD2A 5' sequences were probed, then the FAD2A 3' sequences were probe, and finally the hph sequences were probed (FIG. 34). The rational for this is as follows. The first probe (FAD2A 5') is the diagnostic probe, and if the ETIP has integrated into FAD2A via perfect HDR, a 5,321 bp fragment will be visible on the membrane. The resulting band size is easily differentiated during electroporation and will sit close to the 5,148 bp fragments in the DIG labeled Roche DNA Molecular Weight Marker III® (Roche, Indianapolis, Ind.). The second probe of the membrane is with the FAD2A 3' probe and an edited plant will have a 22,433 bp fragment whereas an unedited plant will have a 16,468 bp fragment. The same 22,433 bp fragment identified with the FAD2A 3' probe should also be bound by and identified with the hph probe. These fragments are difficult to differentiate on a gel as they are extremely large and it may be difficult to determine any difference between a fragment occurring above or below the largest, 21,226 bp fragment in the DIG labeled Roche DNA Molecular Weight Marker III®. As such, these probes provide evidence that may strengthen the identification of ETIP integration into FAD2A via homology directed repair (HDR), by visualization of a 5 kb fragment using the FAD2A 5' probe. The restriction enzyme, KpnI was the only suitable restriction endonuclease for use in this assay, as KpnI sites occurred in a single locus of the cut the ETIP cassette in a single locus, and was present in two sites of the FAD2A ZFN locus. One site was located upstream and the second site located downstream of the FAD2A homology arms. In addition, KpnI is not methylation sensitive, and is available as a recombinant enzyme with increased fidelity (New England Biolabs).

Results of Molecular and Southern Analysis

Figure 35:
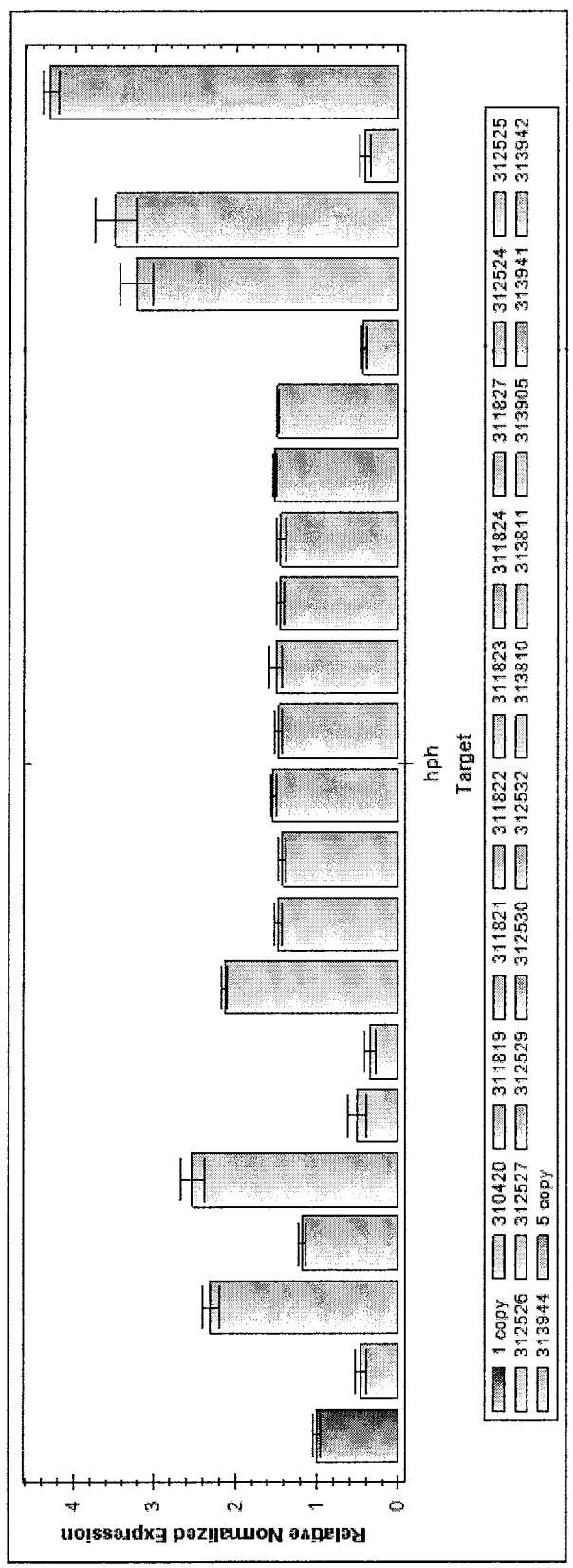
FIG. 35: Shows representative data output from copy number estimation qPCR. The left hand column represents data obtained from a known $T_0$ transgenic plant with a single random transgene insert and is used as the calibrator sample to which all other samples are 'normalized' against. The right hand column is a known T₀ transgenic plant with 5 transgene integrations. The insert copy numbers for both plants was determined using Southern analysis. The remaining columns provide copy number estimates for the putative transgenic plants. The columns are labeled from left to rightffigur as; 1 copy control, 310420, 311819, 311821, 311822, 311823, 311824, 311827, 312524, 312525, 312526, 312527, 312529, 312530, 312532, 313810, 313811, 313905, 313941, 313942, 313944, and 5 copy control. The columns can be used to determine the estimated copy number for each transgenic plant. When using the software to estimate copy numbers, wildtype plants, non-transformed control plants, and plasmid only controls do not result in a copy number as they do not possess a Cq for both the hph and HMG I/Y target.

Following transfection, culturing, and selection the transgenic plants were transferred to soil. From this process, 139 plants survived and had tissue sampled for gDNA extraction and analysis. All 139 plants were analyzed for copy number estimation. Of these 139 plants, 56 were positive for the ETIP and 11 of the 56 positive plants had a putative single copy integration (FIG. 35) (Table 22). Of the 56 plants that were positive for ETIP integration, amplification of the FAD2A 5'-genome-transgene flanking sequence occurred in 7 plants. Amplification of the FAD2A 3'-transgene-genome flanking sequence did not occur in any of the 56 plants that were positive for ETIP integration. Additionally, of the 56 plants that were positive for transgene integration, 11 plants were positive for the disrupted locus qPCR test. Fourteen plants that were positive for amplification of the FAD2A 5' genome-transgene flanking sequence and/or positive for the disrupted locus qPCR test were subject to Southern analysis, with the 3 probes described above. Of the 14 plants advanced for Southern analysis, all of the plants showed partial integration within the FAD2A locus, but none of these plants showed evidence of a complete full-length integration of the ETIP at the FAD2A locus via HDR when probed with the FAD2A 5' probe, FAD2A 3' and hph probes. No bands that appeared to be i) larger than WT and ii) identical to bands observed for those samples when probed with FAD2A 3' probe (Table 22).

TABLE 22

Overview of outcomes from analysis of ETIP integration.

| | |
|---|---|
| No. of plants surviving in soil | 139 |
| No. of plants sampled | 139 |
| No. of plants for which qPCR copy number analysis was completed | 139 |
| No. of plants positive for ETIP integration | 56 |
| No. of plants comprising a putative single copy insert | 11 |
| No. of ETIP/FAD2 in-out 5' reactions | 7 (from 56) |
| No. of ETIP/FAD2 in-out 3' reactions | 0 (from 56) |
| No. of locus disrupted qPCR tests | 9 (from 56) |
| ETIP on-target (Southern) | 0 (from 14) |

Results of ETIP Transgenic Canola Transformed with pDAS000130 and pDAB104010.

The transgenic Brassica napus events which are produced via transformation of pDAS000130 and pDAB104010 result in the integration of a single copy, full length T-strand insertion of the ETIP polynucleotide sequence from pDAS000130 within the FAD2A locus. Three to four events are fully characterized and confirmed to contain the integrated ETIP. The confirmation is completed using an in-out PCR amplification method, and further validated via Southern blot. The selected $T_0$ events are grown to the $T_1$ stage of development. The $T_1$ plants are re-screened to determine the zygosity of the integrated T-strand. Screened events are categorized as homozygous, hemizygous, or null.

The homozygous events are used to produce protoplasts via the previously described method. The protoplasts are subsequently co-transformed with a Zinc Finger Nuclease that is designed to target a Zinc Finger binding site which is incorporated within the ETIP sequence and a donor plasmid which shares homology with specific regions of the ETIP wherein the donor is integrated within the ETIP via an HDR mechanism. Likewise, the protoplasts are subsequently co-transformed with a Zinc Finger Nuclease that is designed to target a Zinc Finger binding site which is incorporated within the ETIP sequence and a donor plasmid which does not share homology with specific regions of the ETIP, wherein the donor is integrated within the ETIP via an non-homologous end joining mechanism. The Zinc Finger Nuclease cleaves the ETIP locus and the donor plasmid is integrated within the genome of Brassica napus cells via homology directed repair or non-homologous end joining. As a result of the integration of the donor plasmid, the partial DS-red transgene is repaired to a full length DS-red transgene. The expression of the now fully operational DS-red transgene is used to sort protoplast cells with a FACS method. Putative transgenic plants are sorted using the FACS method described in Example 7 and the isolated protoplasts are regenerated into mature plants. The integration of the donor plasmid is confirmed within the ETIP-targeted plants using molecular confirmation methods. As such, the ETIP locus serves as a site-specific locus for gene targeted integration of a donor polynucleotide sequence.

Results of ETIP Transgenic Canola Transformed with Zinc Finger Nuclease and pDAS000271-pDAS000275 ETIP Constructs The transgenic Brassica napus events which are produced via transformation of ETIP and Zinc Finger Nuclease constructs result in the integration of a single copy, full length T-strand insertion of the ETIP polynucleotide sequence from pDAS000273 or pDAS275 within the FAD3A locus, and from pDAS000271, pDAS000272 or pDAS000274 into the FAD3C locus. Three to four events are fully characterized and confirmed to contain the integrated ETIP. The confirmation is completed using an in-out PCR amplification method, and further validated via Southern blot. The selected $T_0$ events are grown to the $T_1$ stage of development. The $T_1$ plants are res-screened to determine the zygosity of the integrated T-strand. Screened events are categorized as homozygous, hemizygous, or null.

The homozygous events are used to produce protoplasts via the previously described method. The protoplasts are subsequently co-transformed with a Zinc Finger Nuclease that is designed to target a Zinc Finger binding site which is incorporated within the ETIP sequence and a donor plasmid which shares homology with specific regions of the ETIP. The Zinc Finger Nuclease cleaves the ETIP locus and the donor plasmid is integrated within the genome of *Brassica napus* cells via homology directed repair. As a result of the integration of the donor plasmid, the partial DS-red transgene is repaired to a full length DS-red transgene. The expression of the now fully operational DS-red transgene is used to sort protoplast cells with a FACS method. Putative transgenic plants are sorted using the FACS method described in Example 7 and the isolated protoplasts are regenerated into mature plants. The integration of the donor plasmid is confirmed within the ETIP-targeted plants using molecular confirmation methods. As such, the ETIP locus serves as a site-specific locus for gene targeted integration of a donor polynucleotide sequence.

Example 7

FACS Based Sorting of Protoplast Cells

*Brassica napus* protoplasts that were transfected with the DS-Red control construct, pDAS000031, were sorted via FACS-mediated cell sorting using a BD Biosciences Influx-Cell Sorter™ (San Jose, Calif.). The protoplast cells were isolated and transfected as described in Example 3. After the cells had been transfected with pDAS000031, the cells were sorted using the FACS sorter with the conditions described in Table 23.

TABLE 23

Conditions used for sorting protoplast cells transfected with pDAS000031. Parameters

| | |
|---|---|
| Drop frequency | 6.1 KHz |
| Nozzle diameter | 200 μm |
| Sheath pressure | 4 psi |
| Recovery media | W5 media |
| Culture conditions | Bead type culture using sea-plaque agarose and sodium alginate |
| Sort criteria | Sorting based on chlorophyll autofluorescence, reporter gene expression (Ds-Red) |
| Sort recovery (%) | 50-75 |
| Viability post sorting (%) | >95 |

The protoplasts which expressed the DS-red transgene were sorted and isolated. The FACS isolated protoplasts were counted using the sorter. About $1\times10^5$ to $1.8\times10^5$ of cells were placed in a well of a 24-well micro titer plate on the first day after the FACS isolation. The cells were transferred to a bead culture for 5 to 20 days. Similar conditions were tested, wherein about $1\times10^4$ of cells were placed in a well of a 2 or 4-well micro titer plate on the second day after the FACS isolation. The various conditions that were tested resulted in the recovery of cells at a viability or 95-98% of the total isolated protoplast cells. The FACS sorted protoplast cells were transferred to a bead culture for 3-20 days. The FACS sorted protoplast cells were regenerated into plants on media which contained 1.5 mg/mL of hygromycin using the above described protocol. The putative transgenic plants were confirmed to contain an intact T-strand insert from pDAS000031 via molecular conformation protocols.

Targeting of ETIP Lines with ZFN Mediated Homologous Recombination of DS-Red

A canola line containing the T-strand insert from pDAS000036 was obtained and confirmed via molecular characterization to contain a full length, single copy of the T-strand. This canola event was labeled as pDAS000036-88 and was used to produce protoplasts via the previously described method. The protoplasts were isolated and ~50,000 canola protoplast cells were subsequently co-transformed with a Zinc Finger Nuclease, either pDAS000074 (FIG. 25) or pDAS000075 (FIG. 26), that was designed to target the Zinc Finger binding sites incorporated within the ETIP sequence and a donor plasmid, pDAS000064, pDAS000068, pDAS000070, or pDAS000072 (FIG. 27, FIG. 28, FIG. 29, and FIG. 30, respectively), which shares homology with specific regions of the ETIP. FIG. 19 and FIG. 20 provide illustrations of the homology directed repair which results in the site-specific integration of the Ds-red transgene via Zinc Finger Nuclease mediated homologous recombination. The Zinc Finger Nuclease was designed to cleave the ETIP locus at a defined Zinc Finger binding sequence, thereby creating a double strand break within the genome. Next, the donor plasmid was integrated within the genome of *Brassica napus* protoplast cells via homology directed repair. The intron-1 and intron-2 regions of the donor plasmid share homology with the corresponding intron-1 and intron-2 regions of the ETIP locus. As a result of the integration of the donor plasmid, the partial DS-red transgene was repaired to a full length, highly expressing DS-red transgene. The expression of the fully operational DS-red transgene was used to sort protoplast cells with the above described FACS method. As such, the ETIP locus serves as a site-specific locus for targeted integration of a donor polynucleotide sequence. Finally, the isolated protoplasts can be sorted and regenerated into mature plants. The integration of the donor plasmid can be confirmed within the ETIP-targeted plants using molecular confirmation methods.

The donor plasmid DNA and ZFN plasmid DNA were mixed at various concentrations and used to transfect the canola protoplast cells containing Event pDAS000036-88, and the transgenic protoplast cells were sorted using the FACS transfection that was previously described. Table 24 describes the various transfection experiments and the DNA concentrations which were used for the transfection of the canola protoplasts containing Event pDAS000036-88. The ZFN and donor plasmid DNA was isolated and prepared for the transfections via the previously described methods.

TABLE 24

Donor plasmids and Zinc Finger Nuclease constructs used for the ETIP targeting experiments. The DNA concentrations were used at the indicated ratio of donor to Zinc Finger Nuclease, for a total concentration of 30 micrograms of plasmid DNA per transfection.

| REACTIONS | PLASMIDS | DONOR PLASMID DNA (μg) | ZFN PLASMID DNA (μg) | TOTAL (μg) |
|---|---|---|---|---|
| 1 | pDAS000074 | — | 30 | 30 |
| 2 | pDAS000075 | — | 30 | 30 |
| 3 | pDAS000064 + pDAS000074 | 26 | 4 | 30 |

TABLE 24-continued

Donor plasmids and Zinc Finger Nuclease constructs used for the ETIP targeting experiments. The DNA concentrations were used at the indicated ratio of donor to Zinc Finger Nuclease, for a total concentration of 30 micrograms of plasmid DNA per transfection.

| REACTIONS | PLASMIDS | DONOR PLASMID DNA (µg) | ZFN PLASMID DNA (µg) | TOTAL (µg) |
|---|---|---|---|---|
| 4 | pDAS000064 + pDAS000075 | 26 | 4 | 30 |
| 5 | pDAS000068 + pDAS000074 | 28 | 2 | 30 |
| 6 | pDAS000068 + pDAS000075 | 28 | 2 | 30 |
| 7 | pDAS000070 + pDAS000074 | 28 | 2 | 30 |
| 8 | pDAS000070 + pDAS000075 | 28 | 2 | 30 |
| 9 | pDAS000072 + pDAS000074 | 28 | 2 | 30 |
| 10 | pDAS000072 + pDAS000075 | 28 | 2 | 30 |
| 11 | pDAS000064 | 30 | — | 30 |
| 12 | pDAS000068 | 30 | — | 30 |
| 13 | pDAS000070 | 30 | — | 30 |
| 14 | pDAS000072 | 30 | — | 30 |

After the transfection experiments were completed the protoplasts were incubated at room temperature for 48 hours and sorted using the above described FACS protocol. Each experiment was sorted independently and Zinc Finger-mediated introgression of a transgene was confirmed via identification of individual events which expressed the DS-red transgene. FIGS. 21-24 show the results of the FACS sorting. As the results depicted in the graphs indicate, multiple events were produced which contained an intact fully integrated DS-red transgene. These multiple Ds-Red events were the result of Zinc Finger Nuclease mediated integration of the donor DNA construct within the ETIP genomic locus. This site-specific integration resulted in a highly expressing, complete copy of the Ds-Red transgene. The frequency of the Ds-Red transgene expression ranged from about 0.03-0.07% of the total canola protoplast cells (~50,000). However, the frequency of transfection efficiency for the Zinc Finger Nuclease mediated integration of the donor DNA construct within the ETIP genomic locus was much higher and ranged from about 0.07-0.64%.

FIG. 21 shows the results of the transfections in which the donor plasmid and ZFN plasmid were co-transformed. The top graph, wherein donor, pDAS000064, and the Zinc Finger Nuclease, pDAS000074, were co-transformed at a ratio of 26 µg to 4 µg of plasmid DNA resulted in the Zinc Finger Nuclease mediated integration of the donor DNA construct within the ETIP genomic locus at a recombination frequency of about 0.03% of the ~50,000 canola protoplast cells. In actuality, the recombination frequency is much higher. Of the ~50,000 canola protoplast cells which were provided during the transfection experiment, only about 10-30% of these canola protoplast cells are actually transformed. As such, the actual Zinc Finger Nuclease mediated integration of the donor DNA construct within the ETIP genomic locus transfection efficiency ranges from about 0.22-0.07%. Similarly the bottom graph, wherein donor, pDAS000064, and the Zinc Finger Nuclease, pDAS000075, were co-transformed at a ratio of 26 µg to 4 µg of plasmid DNA resulted in the Zinc Finger Nuclease mediated integration of the donor DNA construct within the ETIP genomic locus at a recombination frequency of about 0.03% of the ~50,000 canola protoplast cells. In actuality, the recombination frequency is much higher. Of the ~50,000 canola protoplast cells which were provided during the transfection experiment, only about 10-30% of these cells are actually transfected. As such, the actual Zinc Finger Nuclease mediated integration of the donor DNA construct within the ETIP genomic locus transfection efficiency ranges from about 0.26-0.08%. The results of the zinc finger mediated homology directed repair are significantly greater than the negative control experiments, wherein only one protoplast of ~50,000 was identified to have red flouresence, thereby resulting in a recombination frequency of 0.00%, as shown in FIG. 20.

FIG. 22 shows the results of the transfections in which the donor plasmid and ZFN plasmid were co-transformed. The top graph, wherein donor, pDAS000068, and the Zinc Finger Nuclease, pDAS000074, were co-transformed at a ratio of 28 µg to 2 µg of plasmid DNA resulted in the Zinc Finger Nuclease mediated integration of the donor DNA construct within the ETIP genomic locus at a recombination frequency of about 0.03% of the ~50,000 canola protoplast cells. In actuality, the recombination frequency is much higher. Of the ~50,000 canola protoplast cells which were provided during the transfection experiment, only about 10-30% of these canola protoplast cells are actually transformed. As such, the actual Zinc Finger Nuclease mediated integration of the donor DNA construct within the ETIP genomic locus transfection efficiency ranges from about 0.22-0.07%. Similarly the bottom graph, wherein donor, pDAS000068, and the Zinc Finger Nuclease, pDAS000075, were co-transformed at a ratio of 28 µg to 2 µg of plasmid DNA resulted in the Zinc Finger Nuclease mediated integration of the donor DNA construct within the ETIP genomic locus at a recombination frequency of about 0.04% of the ~50,000 canola protoplast cells. In actuality, the recombination frequency is much higher. Of the ~50,000 canola protoplast cells which were provided during the transfection experiment, only about 10-30% of these cells are actually transfected. As such, the actual Zinc Finger Nuclease mediated integration of the donor DNA construct within the ETIP genomic locus transfection efficiency ranges from about 0.38-0.12%. The results of the zinc finger mediated homology directed repair are significantly greater than the negative control experiments, wherein only one protoplast of ~50,000 was identified to have red flouresence, thereby resulting in a recombination frequency of 0.00%, as shown in FIG. 20.

FIG. 23 shows the results of the transfections in which the donor plasmid and ZFN plasmid were co-transformed. The top graph, wherein donor, pDAS000070, and the Zinc Finger Nuclease, pDAS000074, were co-transformed at a ratio of 28 µg to 2 µg of plasmid DNA resulted in the Zinc Finger Nuclease mediated integration of the donor DNA construct within the ETIP genomic locus at a recombination frequency of about 0.07% of the ~50,000 canola protoplast cells. In actuality, the recombination frequency is much higher. Of the ~50,000 canola protoplast cells which were provided during the transfection experiment, only about 10-30% of these canola protoplast cells are actually transformed. As such, the actual Zinc Finger Nuclease mediated integration of the donor DNA construct within the ETIP genomic locus transfection efficiency ranges from about 0.64-0.21%. Similarly the bottom graph, wherein donor, pDAS000070, and the Zinc Finger Nuclease, pDAS000075, were co-transformed at a ratio of 28 µg to 2 µg of plasmid DNA resulted in the Zinc Finger Nuclease mediated integration of the donor DNA construct within the ETIP genomic locus at a recombination frequency of about 0.04% of the ~50,000 canola protoplast cells. In actuality, the recombination frequency is much higher. Of the ~50,000 canola protoplast cells which were provided during the transfection experiment, only about 10-30% of these cells are actually transfected. As such, the actual Zinc Finger Nuclease mediated integration of the donor DNA construct within the ETIP genomic locus transfection efficiency ranges from about 0.34-0.11%. The results of the zinc finger mediated homology directed repair are significantly greater than the negative control experiments, wherein only one protoplast of ~50,000 was identified to have red flouresence, thereby resulting in a recombination frequency of 0.00%, as shown in FIG. 20.

FIG. 24 shows the results of the transfections in which the donor plasmid and ZFN plasmid were co-transformed. The top graph, wherein donor, pDAS000072, and the Zinc Finger Nuclease, pDAS000074, were co-transformed at a ratio of 28 µg to 2 µg of plasmid DNA resulted in the Zinc Finger Nuclease mediated integration of the donor DNA construct within the ETIP genomic locus at a recombination frequency of about 0.07% of the ~50,000 canola protoplast cells. In actuality, the recombination frequency is much higher. Of the ~50,000 canola protoplast cells which were provided during the transfection experiment, only about 10-30% of these canola protoplast cells are actually transformed. As such, the actual Zinc Finger Nuclease mediated integration of the donor DNA construct within the ETIP genomic locus transfection efficiency ranges from about 0.62-0.20%. Similarly the bottom graph, wherein donor, pDAS000072, and the Zinc Finger Nuclease, pDAS000075, were co-transformed at a ratio of 28 µg to 2 µg of plasmid DNA resulted in the Zinc Finger Nuclease mediated integration of the donor DNA construct within the ETIP genomic locus at a recombination frequency of about 0.05% of the ~50,000 canola protoplast cells. In actuality, the recombination frequency is much higher. Of the ~50,000 canola protoplast cells which were provided during the transfection experiment, only about 10-30% of these cells are actually transfected. As such, the actual Zinc Finger Nuclease mediated integration of the donor DNA construct within the ETIP genomic locus transfection efficiency ranges from about 0.44-0.14%. The results of the zinc finger mediated homology directed repair are significantly greater than the negative control experiments, wherein only one protoplast of ~50,000 was identified to have red fluorescence, thereby resulting in a recombination frequency of 0.00%, as shown in FIG. 20.

The FACS sorting method is directly applicable to screen any fluorescent transgene sequence and is used to isolate a proportion of *Brassica napus* protoplast cells that are targeted with a fluorescent transgene via homology mediated repair within a specific site in the ETIP region within a genomic locus.

Example 8

Additional ETIP Designs

Construction of Plant Transformation Vectors

Gateway® (INVITROGEN) entry and destination vectors were constructed by standard molecular cloning methods and were used for creating final expression vectors. Entry vector (pDAB105852) comprised a RB7 MAR sequence (Hall et al., 1991) and eZFN4 Binding site v1 (U.S. Patent Publication No. 20110191899, herein incorporated by reference in its entirety). Another entry vector (pDAB105853) comprised expression cassette comprising Rice Ubiquitin 3 (OsUbi3) promoter (Sivamani, E., Qu, R., (2006) Plant Molecular Biology 60; 225-239), yellow fluorescent protein (PhiYFP) marker gene coding region (Shagin, D. A., (2004) *Mol Biol Evol.* 21; 841-50)(Evrogen, Moscow Russia) containing ST-LS1 (Vancanneyt, G., (1990) *Mol Gen Genet.* 220; 245-50) intron followed by a fragment comprising a 3' untranslated region (UTR) from a maize peroxidase 5 gene (ZmPer5 3'UTR v2; U.S. Pat. No. 6,699,984), eZFN1 binding site, and Engineered Landing Pad (ELP1 HR2 v2) (U.S. Patent Publication No. 20110191899). Further entry vector (pDAB105850) comprised a Cry34Ab1 protein coding region (U.S. Pat. No. 8,273,535) under the expression control of a copy of a maize Ubiquitin 1 promoter with intron 1 (ZmUbi1 promoter v8) (Christensen, A. H., Quail, P. H., (1996) Transgenic Research 5; 213-218; Christensen, A. H., (1992) Plant Molecular Biology 18; 675-689), and a fragment comprising a StPinII 3'UTR from potato (An, G., (1989) Plant Cell. 1; 115-22). An additional entry vector (pDAB105851) comprised Wheat peroxidase (TaPer) promoter (Hertig, C., (1991) *Plant Mol. Biol.* 16; 171-4) and Cry35Ab1 (U.S. Patent Publication No. 20110191899) protein coding region followed by a fragment comprising a StPinII 3'UTR from potato.

Figure 36:
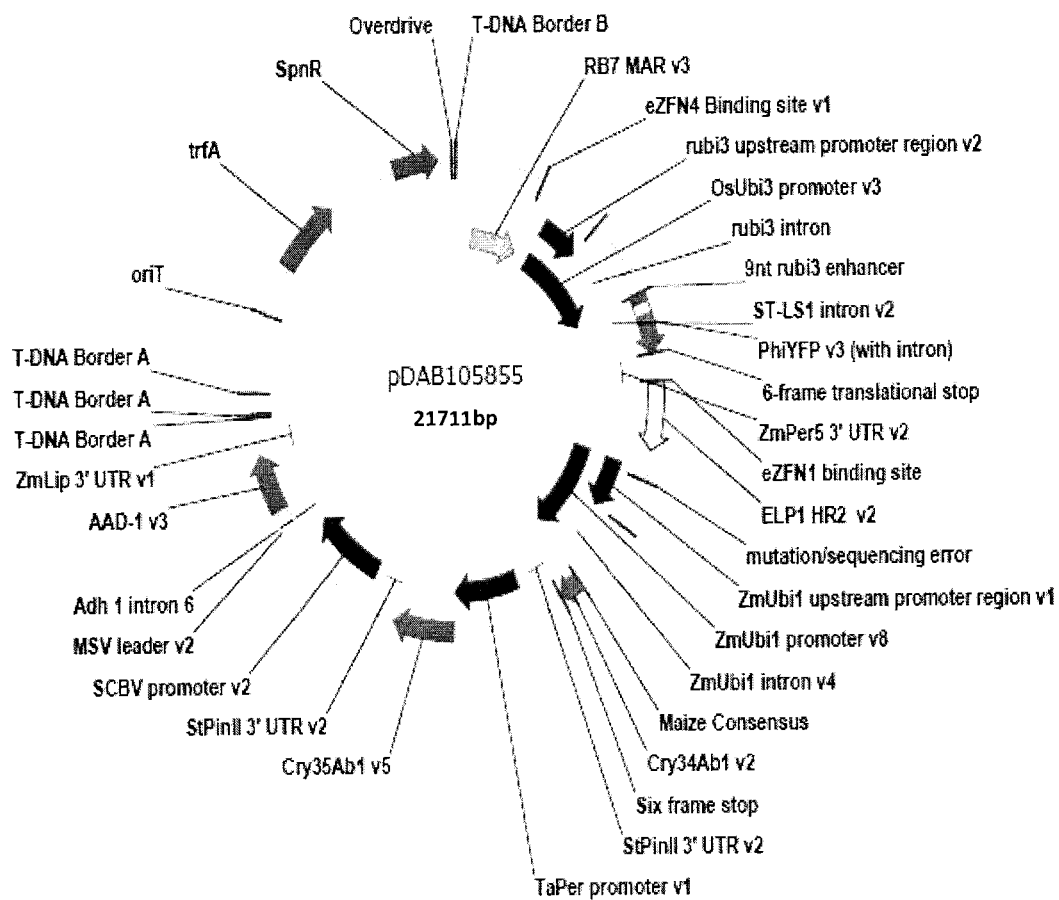
FIG. 36: Shows a plasmid map of pDAB105855 containing target DNA sequence comprising; RB7 MAR sequence/eZFN4 Binding site v1, OsUbi3 promoter/Phi YFP/ZmPer5 3'UTR v2/eZFN1 binding site/ELP1 HR2 v2, ZmUbi1 promoter v8/Cry34Ab1 v2/StPinII 3' UTR v2, TaPer promoter v3/Cry35Ab1 v5/StPinII 3' UTR v2, SCBVv2/AAD-1v3/ZmLip 3' UTR v1 between T-DNA borders.

Transformation/expression vectors for *Agrobacterium*-mediated maize embryo transformation were constructed through the use of standard cloning methods and Gateway® recombination reactions employing a typical destination binary vector (pDAB109805) and entry vectors as described above. Binary destination vector pDAB109805 comprised a herbicide tolerance gene (aryloxyalknoate dioxygenase (AAD-1); (U.S. Pat. No. 7,838,733) under the expression control of a sugarcane bacilliform virus (SCBV) promoter; essentially as described in U.S. Pat. No. 6,093,569. A fragment comprising a 3'UTR from a maize lipase gene (ZmLip 3'UTR, U.S. Pat. No. 7,179,902) was used to terminate transcription of the AAD-1 mRNA. The expression of AAD-1 confers tolerance to herbicidal compounds such as haloxyfop and quizalofop. The Gateway® recombination reaction was used to recombine entry vectors pDAB105852, pDAB105853, pDAB105850, and pDAB105851 with destination vector pDAB109805 to obtain expression vector pDAB105855 (FIG. 36) that was used as a Target vector. The ETIP plasmid pDAB105855 contains target DNA sequence comprising; RB7 MAR sequence/eZFN4 Binding site v1, OsUbi3 promoter/Phi YFP/ZmPer5 3'UTR v2/eZFN1 binding site/ELP1 HR2 v2, ZmUbi1 promoter v8/Cry34Ab1 v2/StPinII 3' UTR v2, TaPer promoter v3/Cry35Ab1 v5/StPinII 3' UTR v2, SCBVv2/AAD-1v3/ZmLip 3' UTR v1 between T-DNA borders. The pDAB105855 plasmid is an ETIP plasmid and was used for integration within the maize genome.

Figure 37:
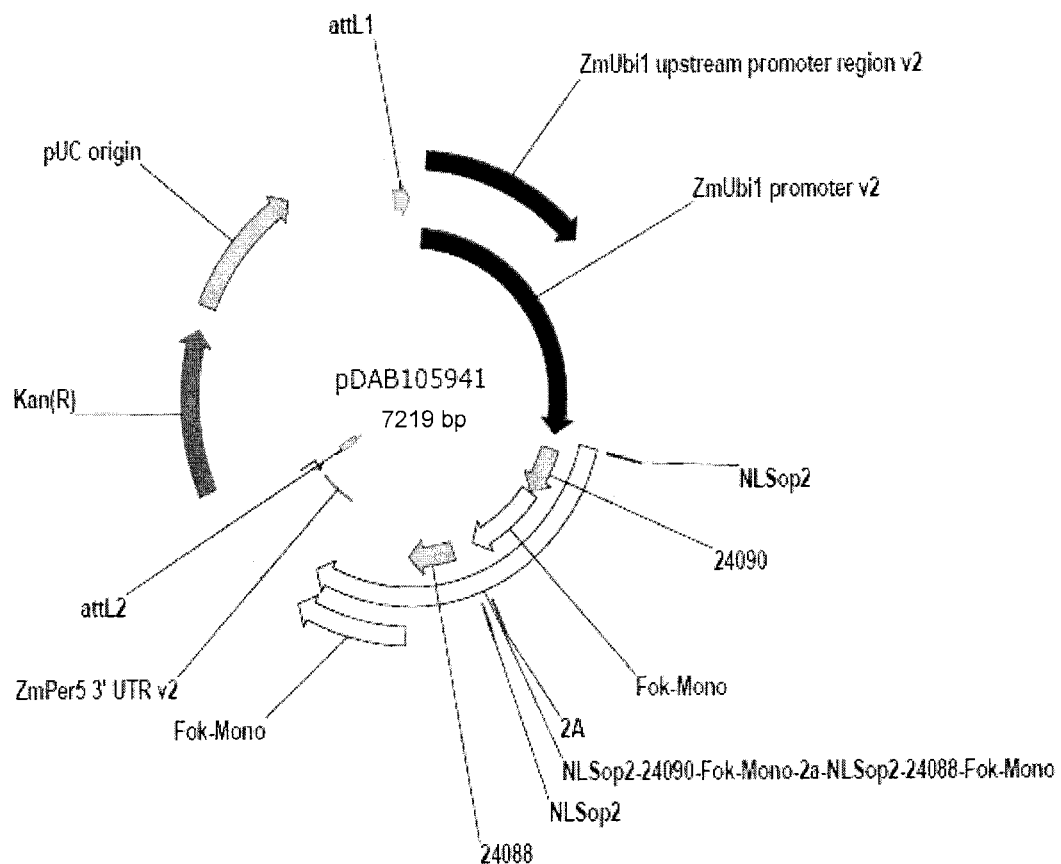
FIG. 37: Shows a plasmid map of pDAB105941 comprising a ZFN1 coding sequence under the expression of maize Ubiquitin 1 promoter with intron1 (ZmUbi1 promoter v2) and ZmPer5 3'UTR v2.
Figure 38:
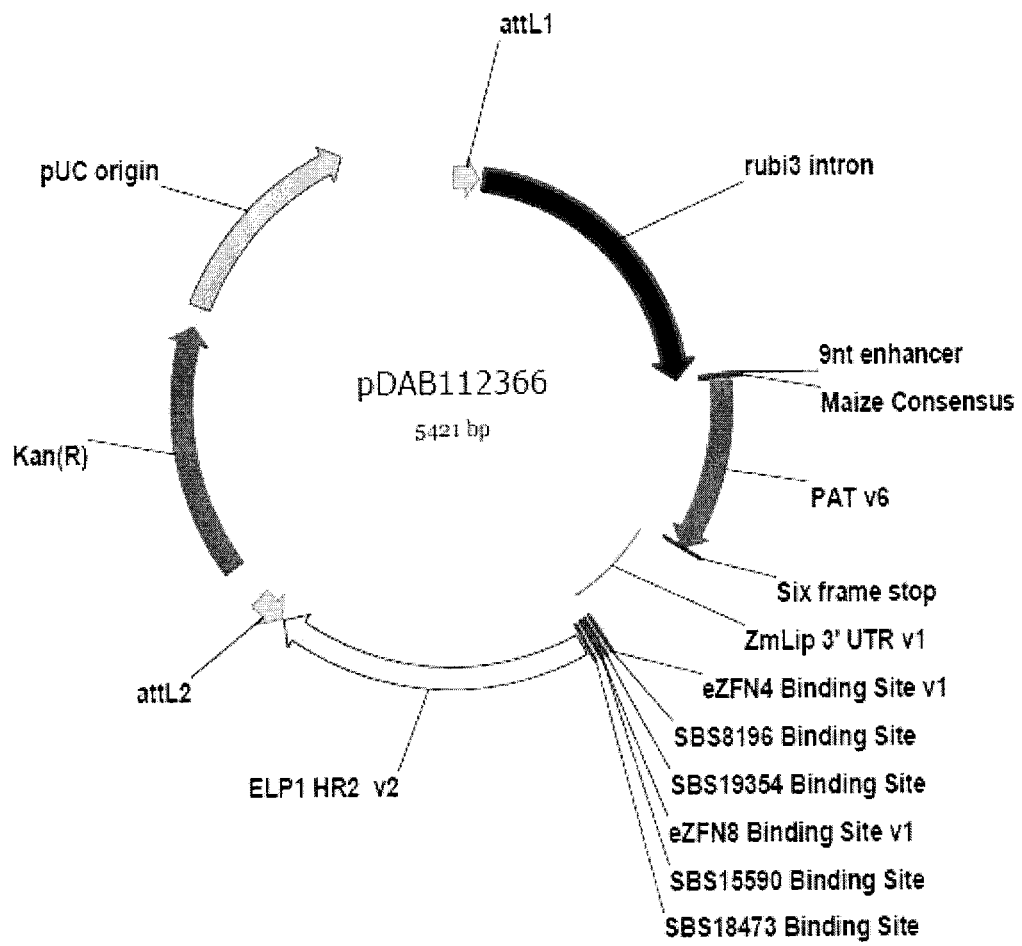
FIG. 38: Shows a plasmid map of pDAB112366 containing promoterless intron (rubi3 intron) of Rice Ubiquitin 3 (OsUbi3) promoter followed by a herbicide tolerance gene (phosphinothricin acetyl transferase (PAT); and ZmLip 3'UTR.

The Zinc Finger Nuclease (ZFN1) vector (pDAB105941; FIG. 37) comprised a ZFN1 coding sequence under the expression of maize Ubiquitin 1 promoter with intron 1 (ZmUbi1 promoter v2) and ZmPer5 3'UTR v2. The donor vector (pDAB112366; FIG. 38) contained promoterless intron (rubi3 intron) of Rice Ubiquitin 3 (OsUbi3) promoter followed by a herbicide tolerance gene (phosphinothricin acetyl transferase (PAT); Wehrmann et al. (1996) Nature Biotechnology 14:1274-1278), and ZmLip 3'UTR. This donor configuration without active promoter does not produce message of PAT gene for herbicide selection. The ZmLip 3'UTR in donor vector is followed by eZFN4 and eZFN8 binding sites, and ELP1 HR2 v2 as described in U.S. Patent Publication No. 20110191899. The 5' rubi3 intron and 3' ELP1 HR2 v2 sequences in donor (pDAB112366) are used for 5' and 3' homologies with target (pDAB105855) for gene targeting to precisely replace Phi YFP sequence in the target with PAT sequence of donor resulting into functional PAT driven by Rice Ubiquitin 3 (OsUbi3) promoter making positive selection for gene targeting.

A positive PAT control vector (pDAB112364) comprised Rice Ubiquitin 3 (OsUbi3) promoter driving the herbicide tolerance gene (phosphinothricin acetyl transferase (PAT) followed by ZmLip 3'UTR was constructed and used in subsequent experiments.

Transformation of *Agrobacterium tumefaciens*

The binary expression vectors were transformed into *Agrobacterium tumefaciens* strain DAt13192 ternary (International Pat. Pub. No. WO 2012016222). Bacterial colonies were isolated, and binary plasmid DNA was isolated and confirmed via restriction enzyme digestion.

*Agrobacterium*-Mediated Transformation

*Agrobacterium*-mediated transformation was used to stably integrate the above described transgenes into the plant genome and thus generate transgenic maize cells, tissues, and plants that produce AAD-1. Maize transformation methods employing superbinary or binary transformation vectors are known in the art, as described, for example, in International PCT Publication No. WO2010/120452. Transformed tissues were selected by their ability to grow on haloxyfop- or bialaphos-containing medium.

*Agrobacterium* Culture Initiation

Glycerol stocks of the project vectors were provided in the *Agrobacterium tumefaciens* host strain DAt13192 (WO 2012/016222A2). *Agrobacterium* cultures were streaked from glycerol stocks onto AB minimal medium and incubated at 20° C. in the dark for 3 days containing appropriate antibiotics. The cultures were then streaked onto a plate of YEP medium with antibiotics and incubated at 20° C. in the dark for 1 day.

On the day of an experiment, a mixture of Inoculation Medium and acetosyringone (Frame et al. (2011) Methods in Molecular Biology 710:327-341) was prepared in a volume appropriate to the number of constructs in the experiment and pipetted into a sterile, disposable, 250 mL flask. Inoculation Medium contains: 2.2 gm/L MS salts; 1×ISU Modified MS Vitamins (Frame et al., ibid.) 68.4 gm/L sucrose; 36 gm/L glucose; 115 mg/L L-proline; and 100 mg/L myo-inositol; at pH 5.4.) Acetosyringone was added to the flask containing Inoculation Medium to a final concentration of 200 μM from a 1 M stock solution in 100% dimethyl sulfoxide.

For each construct, 1 or 2 inoculating loop fulls of *Agrobacterium* from the YEP plate were suspended in 15 mL of the Inoculation Medium/acetosyringone mixture inside a sterile, disposable, 50 mL centrifuge tube, and the optical density of the solution at 550 nm ($OD_{550}$) was measured in a spectrophotometer. The suspension was then diluted to $OD_{550}$ of 0.3 to 0.4 using additional Inoculation Medium/acetosyringone mixture. The tube of *Agrobacterium* suspension was then placed horizontally on a platform shaker set at about 75 rpm at room temperature and shaken for 1 to 4 hours before use.

Ear Sterilization and Embryo Isolation

Ears from *Zea mays* cultivar B104 were produced in a greenhouse and harvested 10 to 12 days post pollination. Harvested ears were de-husked and surface-sterilized by immersion in a 20% solution of commercial bleach (Ultra Clorox® Germicidal Bleach, 6.15% sodium hypochlorite; with two drops of TWEEN 20) for 20 minutes, followed by three rinses in sterile, deionized water inside a laminar flow hood. Immature zygotic embryos (1.8 to 2.2 mm long) were aseptically excised from each ear and distributed into one or more micro-centrifuge tubes containing 2.0 mL of *Agrobacterium* suspension into which 2 μL of 10% BREAK-THRU® S233 surfactant (Evonik Industries; Essen, Germany) had been added.

*Agrobacterium* Co-Cultivation

Following isolation, the embryos were placed on a rocker platform for 5 minutes. The contents of the tube were then poured onto a plate of Co-cultivation Medium, which contains 4.33 gm/L MS salts; 1×ISU Modified MS Vitamins; 30 gm/L sucrose; 700 mg/L L-proline; 3.3 mg/L Dicamba in KOH (3,6-dichloro-o-anisic acid or 3,6-dichloro-2-methoxybenzoic acid); 100 mg/L myo-inositol; 100 mg/L Casein Enzymatic Hydrolysate; 15 mg/L $AgNO_3$; 200 μM acetosyringone in DMSO; and 3 gm/L agar (SIGMA-ALDRICH, plant cell culture tested) at pH 5.8. The liquid *Agrobacterium* suspension was removed with a sterile, disposable, transfer pipette and co-cultivation plate containing the embryos was placed at the back of the laminar flow hood with the lid ajar for 30 minutes, after which time the embryos were oriented with the scutellum facing up using sterile forceps with the aid of a microscope. The plate was returned to the back of the laminar flow hood with the lid ajar for a further 15 min. The plate was then closed, sealed with 3M™ Micropore™ medical tape, and placed in an incubator at 25° C. with continuous light at approximately 60 $\mu Em^{-2}\ sec^{-1}$ light intensity.

Callus Selection and Regeneration of Transgenic Events

Following the co-cultivation period, embryos were transferred to Resting Medium, which is composed of 4.33 gm/L MS salts; 1×ISU Modified MS Vitamins; 30 gm/L sucrose; 700 mg/L L-proline; 3.3 mg/L Dicamba in KOH; 100 mg/L myo-inositol; 100 mg/L Casein Enzymatic Hydrolysate; 15 mg/L $AgNO_3$; 0.5 gm/L MES (2-(N-morpholino)ethanesulfonic acid monohydrate; PhytoTechnologies Labr.; Lenexa, Kans.); 250 mg/L Cefotaxime; and 7.0 gm/L agar; at pH 5.8. No more than 36 embryos were moved to each plate. The plates were wrapped with Micropore™ tape and incubated at 27° C. with continuous light at approximately 50 μmol m-2 s-1 light intensity for 7 to 10 days. Callused embryos (<18/plate) were then transferred onto Selection Medium I, which is comprised of Resting Medium (above) but with only 6.5 gm/L agar, and with either 100 nM R-Haloxyfop acid (0.0362 mg/L; for selection of transformants harboring the AAD-1 gene) or 5.0 mg/L Bialaphos (for selection of transformants harboring the PAT gene), as appropriate. Bialaphos was provided as Herbiace®. The plates were wrapped with Micropore™ tape and incubated at 27° C. with continuous light at approximately 50 $\mu Em^{-2}\ sec^{-1}$ light intensity for 7 days. Callused embryos (<12/plate) were then transferred to Selection Medium II, which is comprised of Resting Medium (above) but with only 6.5 gm/L agar, and with either 50 nM R-Haloxyfop acid (0.0181 mg/L) or 5.0 mg/L Bialaphos as appropriate. The plates were wrapped and incubated at 27° C. with continuous light at approximately 50 $\mu Em^{-2}\ sec^{-1}$ light intensity for 14 days.

At this stage resistant calli (<9/plate) were moved to Pre-Regeneration medium. Pre-Regeneration Medium contains 4.33 gm/L MS salts; 1×ISU Modified MS Vitamins; 45 gm/L sucrose; 350 mg/L L-proline; 100 mg/L myo-inositol; 50 mg/L Casein Enzymatic Hydrolysate; 1.0 mg/L $AgNO_3$; 0.5 gm/L MES; 0.5 mg/L naphthaleneacetic acid in NaOH; 2.5 mg/L abscisic acid in ethanol; 1 mg/L 6-benzylaminopurine; 250 mg/L Cefotaxime; 5.5 gm/L agar; and either 50 nM R-Haloxyfop acid or 3.0 mg/L Bialaphos, as appropriate; at pH 5.8. The plates were wrapped and incubated at 27° C. with continuous light at approximately 50 $\mu Em^{-2}\ sec^{-1}$ light intensity for 7 days. Regenerating calli (<6/plate) were then transferred to Regeneration Medium in Phytatrays™ (sigma-aldrich) and incubated at 28° C. with 16 hours light/8 hours dark per day at approximately 150 µmol m$^{-2}$ s$^{-1}$ light intensity for 14 days or until shoots developed. Regeneration Medium contains 4.33 gm/L MS salts; 1×ISU Modified MS Vitamins; 60 gm/L sucrose; 0.50 gm/L MES; 125 mg/L Cefotaxime; 5.5 gm/L agar; and either 50 nM R-Haloxyfop acid or 3.0 mg/L Bialaphos, as appropriate; at pH 5.8. Small shoots with primary roots were then isolated and transferred to Elongation Medium without selection (i.e. Regeneration Medium without R-Haloxyfop acid or Bialaphos) for further growth. Rooted plantlets about 6 cm or taller were transplanted into soil and moved to a growth chamber for hardening off.

Transfer and Establishment of to Plants in the Greenhouse for Assay and Seed Production Transformed plant tissues selected by their ability to grow on medium containing either Haloxyfop or Bialaphos, as appropriate, were transplanted from Phytatrays™ to small pots (T. O. Plastics, 3.5" SVD) filled with growing media (ProMix BX; Premier Tech Horticulture), covered with humidomes (Arco Plastics Ltd.), and then hardened-off in a growth room (28° C. day/24° C. night, 16-hour photoperiod, 50-70% RH, 200 µEm$^{-2}$ sec$^{-1}$ light intensity). When plants reached the V3-V4 stage, they were transplanted into Sunshine Custom Blend 160 soil mixture and grown to flowering in the greenhouse (Light Exposure Type: Photo or Assimilation; High Light Limit: 1200 PAR; 16-hour day length; 27° C. day/24° C. night). Putative transgenic plantlets were analyzed for transgene copy number by quantitative real-time PCR assays using primers designed to detect relative copy numbers of the transgenes, and single copy events selected for advancement were transplanted into 5 gallon pots. Observations were taken periodically to track any abnormal phenotypes.

Production of T1S1 Hemizygous Immature Embryos in the Greenhouse for Particle Bombardment To plants transgenic to target sequence were self pollinated to obtain T1 seed. The T1 seed was planted and plants were analyzed for zygosity of the target transgene using qPCR method. The plants homozygous for target transgene were advanced further for pollen production. The pollen from homozygous target plants was used to backcross B 104 corn plants to obtain T1S1 hemizygous immature embryos. The immature embryos were used for particle bombardment with donor and ZFN1 DNA to test gene targeting.

Targeting of Corn Immature Embryos Via Microparticle Bombardment

Three days prior to microparticle bombardment, 1.5-2.2 mm embryos were isolated from surface sterilized ears and placed (scutellum-up) onto N6 basal medium and vitamins (Phytotechnology Laboratories, Shawnee Mission, Kans.) with 2.0 mg/L 2,4-D, 2.8 g/L proline, 30 g/L sucrose, 100 mg/L casein enzymatic hydrolysate, 100 mg/L myo-inositol and 4.25 mg/L silver nitrate solidified with 2.5 g/L Gelzan (Phytotechnology Laboratories, Shawnee Mission, Kans.). Four hours prior to microparticle bombardment, ~35-40 embryos were placed (scutellum up) onto in the center of a 100×15 mm Petri dish containing the same medium with the addition of 36.4 g/L sorbitol and 36.4 g/L mannitol.

Microparticle gold (0.6 micron, BioRad, Hercules, Calif.,) was prepared for DNA precipitation by weighing out 15 mg into a sterile, siliconized 1.7 mL microcentrifuge tube (Sigma-Aldrich, St. Louis, Mo., T3406) and 500 µL of ice cold 100% ethanol was slowly added. After a 15 second sonication in an FS-14 ultrasonic water bath (Fisher Scientific, Nazareth, Pa.), the gold was allowed to settle for 30 minutes at room temperature prior to centrifugation at 3,000 rpm for 60 seconds using a MiniSpin (Eppendorf, Hauppauge, N.Y.). After removing the supernatant, 1 mL of ice cold, sterile water was added, mixed up and down with the pipette and allowed to settle for 3-5 minutes prior to centrifugation at 3,000 for 60 seconds. The wash step was repeated one more time prior to suspending the gold in 500 µL of ice cold, sterile water. The washed gold was then aliquoted into separate 1.7 mL sterile, siliconized microcentrifuge tubes (50 µL per tube) being careful to keep the gold well mixed by pipeting up and down between tubes. The washed gold (~1.5 mg per 50 µL) was then stored at −20° C. until needed.

For DNA precipitation, one tube containing ~1.5 mg of gold in 50 µL of water was thawed for each 10 targets to be bombarded and sonicated in an ultrasonic water bath for 15 seconds then placed on ice. Plasmid DNA (0.6 µg ZFN+4.4 µg Donor) was premixed in 0.6 mL microcentrifuge tubes (Fisher Scientific, Nazareth, Pa.) and added to the gold suspension gently pipeting up and down several times to mix thoroughly. Fifty microliters (50 µL) of ice cold 2.5 M calcium chloride was added and gently mixed by pipeting up and down several times. Twenty microliters (20 µL) of cold 0.1 M spermidine was then added and gently mixed by pipeting up and down several times. The tube was then capped and placed onto a Vortex Genie 2 (Scientific Instruments Inc., Bohemia, N.Y.) and allowed to mix (set at 'shake 2') for 10 minutes after which the mixture was allowed to settle for 3-5 minutes. After centrifuging for 15 seconds at 5,000 rpm, the supernatant was carefully removed and 250 µL of ice cold, 100% ethanol was added, the tube capped and mixed vigorously by hand to dislodge the pellet. After a second centrifuge for 15 seconds at 5,000 rpm, 120 µL of ice cold, 100% ethanol was added, the tube capped and mixed vigorously by hand to dislodge the pellet.

For microparticle bombardment, sterilized macrocarriers (BioRad, Hercules, Calif.) were fit into stainless steel holders (BioRad, Hercules, Calif.) and autoclaved. Ten microliters (10 µL) of gold/DNA suspension was evenly spread in the center of the macrocarrier being sure to pipette up and down so as to keep well mixed then placed onto a piece of sterile 125 mm Whatman #4 filter paper (GE Healthcare, Buckinghamshire, UK) on a bed of 8-mesh Drierite (W.A Hammond Drierite Co., Xenia, Ohio) in a 140×25 mm glass Petri dish. The gold/DNA was allowed to dry completely for about 10 minutes. Rupture discs (650 psi, BioRad, Hercules, Calif.) were sterilized by soaking for a few minutes in isopropyl alcohol then loaded into the retaining cap of a microparticle bombardment devise (PDS-1000, BioRad, Hercules, Calif.). An autoclaved stopping screen (BioRad, Hercules, Calif.) and a loaded macrocarrier was placed into the launch assembly, the lid was screwed on and slide into the bombardment chamber just under the nozzle. The Petri dish containing the screen-covered, leaf target was uncovered and placed in the bombardment chamber 6 cm below the nozzle. A vacuum was pulled (−0.9 bar) and the devise was fired.

Next day (16-20 hours after bombardment), the bombarded embryos were transferred (scutellum-up) to N6 basal medium and vitamins (Phytotechnology Laboratories, Shawnee Mission, Kans.) with 2.0 mg/L 2,4-D, 2.8 g/L proline, 30 g/L sucrose, 100 mg/L casein enzymatic hydrolysate, 100 mg/L myo-inositol.

PAT Optimization for Particle Bombardment Using Positive PAT Control Vector (pDAB112364)

PAT control vector (pDAB112364) was used to standardize tissue culture conditions for the particle bombarded corn embryos. The donor vector (pDAB112366) was tested for with and without ZFN1 vector (pDAB105941) for potential background selection. As shown in the Table 25 below, transformation frequency of 9% was obtained using PAT control vector (pDAB112364). This data show that Rice Ubiquitin 3 (OsUbi3) promoter drives robust expression of PAT gene to obtain selection for plant transformation using particle bombardment of corn B104 immature embryos. A very small number (1-2) of plants were obtained on PAT selection media for the immature embryos bombarded using donor vector (pDAB112366) with or without ZFN1 vector (pDAB105941). These results confirm that donor vector (pDAB112366) that contain rubi3 intron without upstream promoter does not provide transformation selection for PAT gene.

TABLE 25

Shows the transformation frequency for the ETIP constructs within the corn genome.

| Construct | Number of Transformed Embryos | Confirmed Events | Transformation Frequency |
|---|---|---|---|
| pDAB105941/112366 | 480 | 2 | 0.42 |
| pDAB112364 | 720 | 63 | 9 |
| pDAB112366 (donor) | 720 | 1 | 0.14 |

Particle bombardment of immature embryos transgenic to target pDAB105855 using donor and ZFN1 for gene targeting Immature corn embryos hemizygous to target pDAB105855 were treated for particle bombardment using ZFN1 and donor DNA premix (pDAB105941/112366) to obtain gene targeting using positive PAT selection. Table 17 shows that target event and number of embryos that were used for each event. Also indicated in Table 26 are the number of plants that were successfully regenerated on the PAT selection media for each target event. In total, 68 plants were regenerated form 13,563 immature embryos treated covering all the events. The small number of plants obtained on PAT selection media demonstrate that most of the non-targeted random PAT donor insertions were eliminated.

TABLE 26

Shows the target event and the number of embryos that were used for each event.

| Target Event Number | Samples Treated | Events Regenerated |
|---|---|---|
| 105855[4]-001 | 150 | 0 |
| 105855[4]-002 | 2089 | 5 |
| 105855[4]-009 | 720 | 1 |
| 105855[4]-011 | 1918 | 11 |
| 105855[4]-012 | 1350 | 26 |
| 105855[4]-017 | 1929 | 4 |
| 105855[4]-025 | 1155 | 11 |
| 105855[4]-026 | 1103 | 6 |
| 105855[4]-027 | 1654 | 2 |
| 105855[4]-028 | 1495 | 2 |
| Total | 13563 | 68 |

PCR Analysis for ETIP Gene Targeting

QPCR was performed to detect YFP and PAT coding sequence in 67 plants out of 68 total plants that were regenerated on the PAT selection media. The results are summarized in Table 27. As Table 27 indicates, 50 plants were found to be PAT positive using the qPCR assay while 24 plants were negative for YFP coding sequence. The data suggest that 17 plants obtained on PAT selection were escapes and ZFN1 expression has disrupted YFP in the target locus at least in 24 plants.

TABLE 27 qPCR analysis and detection of the YFP and PAT coding sequence in 67 plants.

| Events analyzed | PAT positive | YFP negative |
|---|---|---|
| 67 | 50 | 24 |

Further diagnostic In/Out PCR was performed for 24 YFP negative events to measure gene targeting. 5' In/Out PCR, utilizes target a DNA-specific 5' oligo that anneals to OsUbi3 promoter and a donor DNA-specific 3' oligo that anneals to PAT coding sequence to obtain a expected PCR product of 1838 bp. The expected PCR product will support precise gene targeting at 5' of the target locus. The PCR results confirmed that the expected 1838 bp product was amplified in 21 events.

A similar 3' In/Out PCR was performed. The method utilizes donor DNA-specific 5' oligo that anneals to PAT coding sequence and donor DNA-specific 3' oligo that anneals to ZmUbi1 promoter sequence to obtain a expected PCR product of 2184 bp. The expected PCR product will support precise gene targeting at 3' of the target locus. The PCR results confirmed that an expected amplicon of 2184 bp was produced in 16 events.

The In/Out PCR data for both 5' and 3' of target locus are summarized in Table 28. The data reveal that 15 events resulted in expected PCR products indicating about a 30% gene targeting frequency out of total PAT positive regenerated plants.

TABLE 28

Molecular confirmation analysis for the obtained events.

| Events Analyzed | Confirmed 5' In/Out PCR | Confirmed 3' In/Out PCR | Confirmed 5'-3' In/Out PCR | Targeting Frequency |
|---|---|---|---|---|
| 50 | 21 | 16 | 15 | 30% |

Southern Blot Analysis for Gene Targeting

Figure 39:
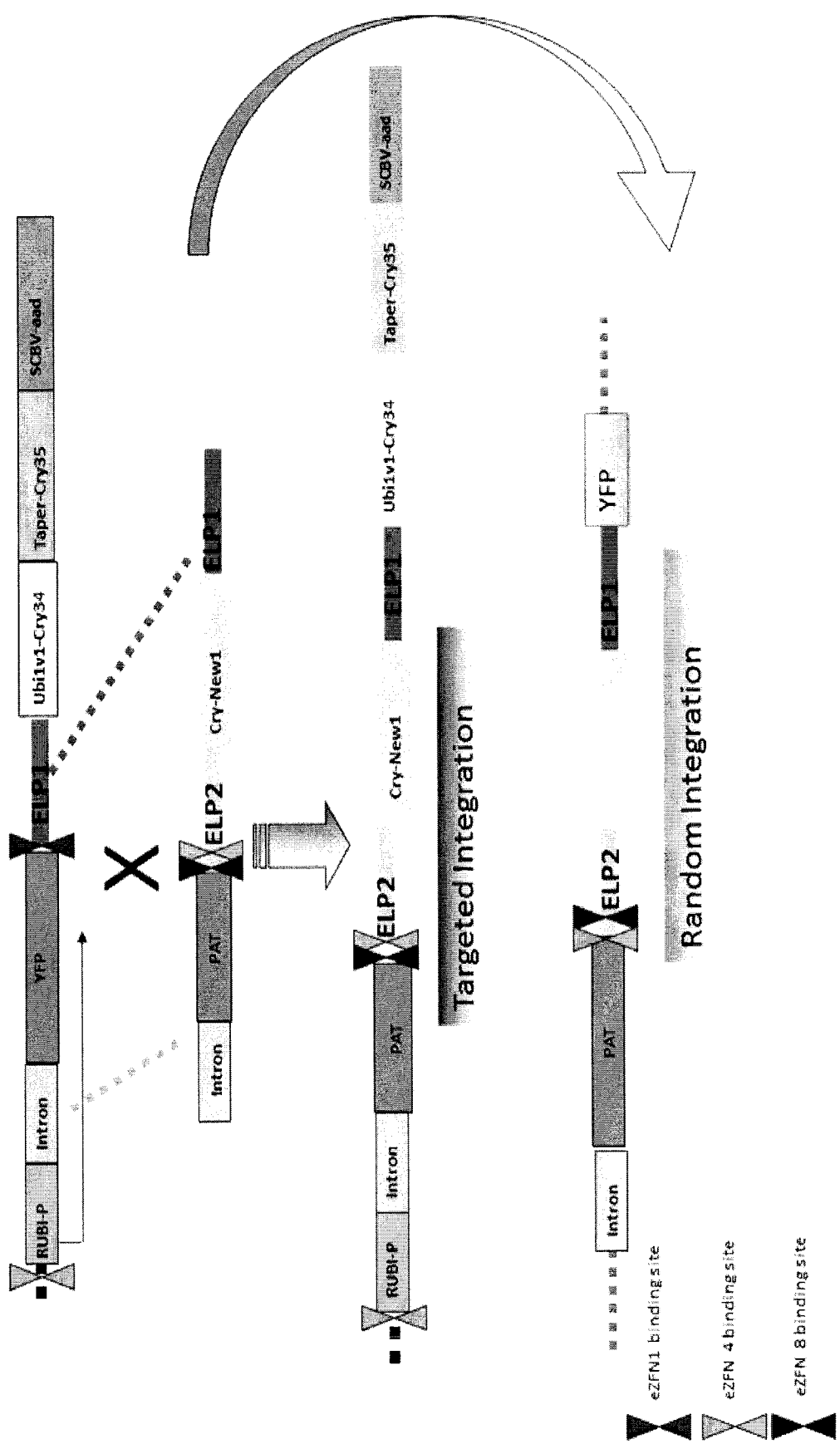
FIG. 39: Provides a schematic for using an ETIP site integrated within the genome for targeting of a donor polynucleotide comprising a gene expression cassette. As shown in the scheme, the donor is capable of expression of the transgene if integration occurs within the ETIP locus. Random integration of the donor does not result in expression of the transgene, as there are typically no promoter elements that can drive expression.

The characterization of target events using Southern blot analysis revealed truncation of target transgene in the event #12. A total of 12 events were analyzed for Southern blotting. The data confirmed that the expected banding pattern was identified in 5 plants (3 for event #12 and 2 other events). These results indicated that an ETIP construct that had been integrated within the genome could be subsequently re-targeted with a donor sequence and that the ETIP could serve as a targeting platform. FIG. 39 provides a schematic for using an ETIP site integrated within the genome for targeting of a donor polynucleotide that contains a gene expression cassette. As shown in the scheme, the donor is capable of expression of the transgene if integration occurs within the ETIP locus. Random integration of the donor polynucleotide does not result in expression of the transgene, as there are no promoter elements that can drive expression when the donor polynucleotide integrates randomly within the genome. The targeting of the donor within the ETIP site results in a functional marker gene, that can be detected or selected for.

While certain exemplary embodiments have been described herein, those of ordinary skill in the art will recognize and appreciate that many additions, deletions, and modifications to the exemplary embodiments may be made without departing from the scope of the following claims. In addition, features from one embodiment may be combined with features of another embodiment.

SEQUENCE LISTING (480 sequences)

SEQ ID NO: 1 - DNA, 47493 bp, Brassica napus
ttcccaaacaacacaataagttattgtcaataactaatcttatgtccaaagaatataaaacattaggtccagtctttttaataactttttatttatattttttaaattatttgatttaaatccactcaaataatttatacgaagttgaaaataactataactatttttgcgggtttagatactacagaaaagcatttaacttgaaattaattaaattaaaattttattttgtttgtattttcagaaataaaaaatcgaattccttttaacttaataaatattagattgttctttgtaaattatttttattaattcataagaacatattattatatatgctatattatgcttggtttaagttaaaattaaatagttttatagaaataaaatgttagaatcaataaattaacatcaaataagttttataattaaaattttatcaaataagcatatattaaaaatttaatccaacaaattaaagatgttttcttaaaacctcgtaatgatacaggttgaagtaattaaaaaaaaattaagtaatattttagataattttcctctttaataaaataatttattatgtatgtttaaatacactaaaataaaaatgttaaaacattacttatataataatgttaaaatatattgatattataaattagatttttttttaaagatattttcgcacatttaatcgtgggttatagtctagtatattttaaaacctaactattaaatgctgaattttatgaagttataacataaagtgattaatgaacaaacgtcttatcaattaattatgcttccgcaaagcatcatgttcattgccctataaaatcatctctcgttcactgataccaatcaaacatcaaccaatatcaaaaactaaagcaaatatggcaaagtctctttacattgcaatgtttgtatctatagtaatgttcttcatggcaaattcaatttcttccaaggaaattggtcaatattcacaagaggcaccaggagatgtaaagatatctcccacatcggattttgatatttacgtcgaatctcccgatgaatctctatttgaagaagtcgattcacccgcaatggaatatgagatgaagtctggacatcattacacacacaaacaacttggttttcttgaggcttgctttcaaaatctaaactcattagactgtggagataatattttcaagaacatgttagatgaggcagcacaagtattatcaaatgaatgttgtcatgatctattaaagattagcaaagattgttacctaggaatgactcaaagcattttatcgagttatgagtatagatttattgcgtctaaggctattcccaaaagtaaacagacatggaatgattgtgttcttagagttgggaacctgattggtagcccaatcgcttttgaggaactacactaattgatgttccggtgtgctgatgttttatatatgtgattttgtaactcaggcgttatgagacttaccattatataaataaagctaaagatcttttacagatcttatattagtatacgagactcattagagtaacatgaaagctgaatcaactatcaacattggtggtatttgtctttaggtttctttaatggatatagatgtttggggacaacgctagcagctcttagtaattccgcatatttatggactatgagctcttcgctctaaattacacaatccgacccaccatttcagatatcaatactcgcaaacccagtagagttacagtctctattgtacttctccttgcattccttcagcctgattctcttatccacaatggttatacttgtctctgacaacgatcatgttcctcaagagcaaaaaaccatctaggtctccgcagctcagtggcgagcctctcacacaaccattgaacacatctaccaaagcaaatgacgtggcattcttgggaatgaaacctttgatacagttacatgtcagtatcgtgctaatgttatagtaaacattttattatcatatttttaatactaatgaggcatgatttgattttaatttgcatattttatctcttaatcctggattatatatagttttcagcagacaagaaaatgttatttccacattctatgacttgtttttagactttcatcaattcattacaacatattattgttattagtcgataactttgacttaaccacgtgaattttatcccaaaaaaaacttaaccacctaaaatctaattttttttataaagaaattagtttttgatccgcgttttgcagatttatttttcatttttatatgtttatatctttgagaatgccatgaaattgaccgtgtgtttctattgtgtttagtttttggtctttctaatttttgagattattttttctttaaacgatgcccgggttattattaattttatttgataaattaaacattgaaatataattagaattcgaagtatacttttaggttttatcagttttaaagatggtcatttgatttgaaatttgtataaaaattccaacttttattttggaatttttaaaagaaatatatgtttactgatgtgtggtatattttaataagataaatatattaatataatatggcatagtattatgtagataattaaaatttatatttacaattatgtaatataaaactatagatattattgaaaactataatatttgttgtaatatgaattagtttaaattatgtacaactatctgtgcaaaattacgtagtttgtaaatgtgtatatgtgataaaactataataatacatactatattttaactaatattggtttatatatctaatatatttaattgtgtatttcatattaatcaaaaatataaaagatttaaattagacagaaaccgttcaaaaataaatatagtttttcatttgacccgcaatttcaaaatgcgagatgttttataaataattaacataatctttaattttggaaatgatatatgtttttgaattattttacgttttttatattaccattaacatttattttaaattttaaatgagaaatgattttgtaattgtaactaaaatttatataaatgtaacttatgaaaattaaaaaaaatgtaaccaggataattaccaaaaatagcattttgaatataccacttttcacttctactttattcaactttgccattaaacttttaattggcaaatgactattatatccctaattaattgaacctaaactattcaattagataggttatatattcttcctccatgtgagatccggcgagctccggcaaaggacgatgattggagattattggggatactgtgaacaagaacgaggaacatatctggaaatatgtaaatgggaagagatttctacacagattagattaatgaacatgatatcagattcattgacatcttgtactgattccaattttgtctcgtgcttgttattcctggcttttaatgttttggtgttgatgtatctgatagagcaagtggaaagaggagctggaacaagcggaaagaccgagaaaataaaagtaaccaataaacatggacacgttaaggaagaaactgactccaatgattcagagttttggatgcttaagtcaagttttggttcagagtcagagtaggagagtgatgaagaaaactgcaaaggtacctctttttggtgttttttgttggttctactttcatctttctatcgaaacttaaactagatttgtgtctgatcttggtacaggttctcattgtgatgccagataatatgaggagctctcagaaaggtaaaggtaaatgtatacatttactcttatttctgtgtatttcttacaaaattgcggattggttttgatgttcacctctagttgttttgtctcttctacagagcaaagaggatgtcaatagagattggaccaagtatgatcattacggcagcgccactatgatcatgaggcagtctttggaagagcagatgagttctgttacggagaagagtgctaagtatgctcagattgctgctgaggaagtgcccaagagtctttactgccttggtgttcgtctcactactgagtgatttcagaactcgagttttaggggaagctcgcggagagaatctatgttgtggcttctaagctcaccgataacagtctttaccatgtctatgtgttttctaataacattgttgctacttcggttgtggttaactccactgctctcaaatccaaggcccctgagaaattcgtccttcatcttgtcactaatgcgatgaagtcatggtttgctatgaatatgaacttcttaattgattccggcttggttgattcagtatgtggaaattgcaggtgacgagtgtgcaatcttcgctgtttttagaagcagcatttgcgtcaaatgatatgcagcatttggctgcaatgttaagggtcttgtcggaattgattccaggattcaaagaaactaccgagtattacacattctaaggtcttcttaatgagaccagttccccagttgctgtctgagatttaacatctcttaccttatttatgttcaataacttagataataagaaatttcgttgataatatttcaatttatgtatgtttcattcaaagaaaacaatgattagttttctcaaatcagtcttcttatttgtttgagttaagatcttccaaacttatgtttttttgtaattcaggagtaacaaaatgaatatagtctaaatctggatctaattttgaaatttttttaactggattttctttcaaattaaatccttatttactctttaagaatttttttaaaagtttaggtttgacatctctaacctatacgttgcgaacttggacaaaaccaaaacaagattaagcattgttttcagaatatttaatttttaattttgttgggtttgatttggatctttccagtgtacatatgtttaaacaccatcctcttcaaaacggttgtttaagtgttcatttttgggtaggtccaagacgtgactgggacaattcaaagcgctagttatctccgtaacacatcatatttccccttacattaagataaagtatactcgtgaatctcaattggatgcaataaataaaaacaaaatcccttcccatcaaggcatcaaactgccaaagtcaattctagaaaaatattaaaaactattctttttttattttattttagagacttctcttcctttttattctgtaggaagaaaaaacaaaaaaagaagaagaagaggagaatcgtctctttctttctcttagaccatctacaatgctacgctaaaatttactctatatttcactctaaaatagagtaactctattatagagtgaaatatagagtaaattttagtgttgcattggagatgcccttaactgtatccgtgaaggcaaaaagatacgtataaacaaatacatttacacataaatatgtatatgtatgtatttatactcttctagctctctctctctcacctgtacctttaatatggtgtttctgtttacgagaaaccaaacccacaccaattgaaaacgcgacttgttgttattcaatcgcaatcaacgagtaatctgctacctcgtctcctctctgagatctctcttcctcccattagattcgcctgaggaggtactcattcttattccttttttctctgtctttttatggaattttctaaaaatgctgtaaggtttcagacatatccggtaataactggactctgaactaatgacttgttcaagtgttccagctcttattacatagtaccgatttggattgtgtttttttttttgtttgaccttcttgcaattgtgatgctctgatttgttttcacgttcgtagcttatgctttaatttttttttgtcatttatcttcttttccccctaatttttttttgtttaattgcaaacctttttgtgtgtgcttcggcatgaacttaggggccctactactggcgtaagtttaggcttcttttttggtgcttttttagctttactgcttgttggtggaattcacttttctttttaagttaatttcagagacatccttattgtaactgctcacttttcagtgttgttagtttaaggaatgatgaaagaaagaaagctttctataactgcttgatttagcttcagttgttagtaatatgggttagaactgttagccttgagtagatatcactgtctttattttttggtttattgttgatttatttttgtggtcttgttttgattcagtgttctcgaggttttgacttcgacttgtgatgatggcatcatctaaacaaggatcaaagtcgagaaaaacagggtttagcaatttcaagggtgctgattctactgcttcctcaacaacctcttcttcaaagctttatcaagagacatctatcgatgatggacatagctctcctgcttcttcatctgctcaaagcaagcagcacttcttctcaccggactccgcaccgcaaagtgctcagcgttctaaagagaacgtcacagtgacagttcgctttcgtccactcaggttcacagtgatgtgcttttttattagggcttgcaaatattaggttgcctgtttgttctgtgaatttgaaataacttttccgtgacagtccaagggaaatccgccaaggggaggaggttgcttggtatgcagatggcgaaacaatcgtacggaatgagtataatccgacgatagcttatgcatatggttagtcttaatagtttcattaatgtcacagtggttccataatcatcttaaatattgtatgtcggcatatcactcgagaataacaaactaaggatgatagtgttgttcttatgtggtataatcttccttttttgatgtctgggtctctatgtctgttaacgattggttctctttatgacagatcgtgtctttggacctacaaccacaacacgcaatgtctacgatgttgctgcacaccatgttgttaatggggctatggaggggattaacggtatgaagtgaccatatttaatggcagtctattttgtatttagaactcaatttatgatatcaactcttttatcgaaaagcatactttcttccaaactctatcaacaaggctgactgttcctaatttatgatgaattcgtcagaaccaattttgactttcgatgtacttaccagttgatttgtatataactttgaatgttaatccatctacagggaccatttttgcatatggagtgacaagcagtggaaagactcacactatgcatgtaagataccttcatctggatagcttttggcttgttttgtacgatgtagttcaatttgtcataaagatatagtgctttgtcagagaatcatgtatttcttttaatttcaactccacaagcttaactaacacatgtaagaatctttctgcaatagttatagataaacaaccttgcgatagataagttttctaccctaatactgttaggtttctgtgcaccctactgttgaaaccatatctgatagatttcgattgggtttttttttgggttcaaatgtcagggtgaccagagatctcctggtattataccattagcagtgaaagatgctttcagcattatccaagaggtacttcttaggatattgattttgtcagattccgtggcctaagtactagcaacctcacatatctattttcttacagacaccaagccgagaatttctcctgcgtatttcctacatggaaatttataatgaggtgctattatttatccactttctttctctgctccattacctatattcagcttcaagagtagtggagtgatagaatactctgcctttaaaatcttcctttgagattaattcccttaagatccaccgtatttcaggttgtcaatgatttattgaatccagcaggacataatttgaggatcagagaagataaacaggtatgtgtttcagcttcagatcatcttttgattacacgggctgctgctctcacttacttgtaatattttcttttattacattgctcgtctaaaatcccaaaatgtttacatcatattcttaaattagtaggaacccatgtctaggcttgtttggtacctgaaaactatactggttccatttttttcttgtgaaatttgatctctctgagaactctgctgttacaatgatgatatgtgggtcacattgctttcaagcagacttgtagatgatcgctatgagttcttttcttccatgtgttttaattgaacgcatccttttaatttattctagggaacctttgtcgaagggattaaagaagaagttgttttatcacctgctcatgcgctttctcttatagcagctggagaaggtatgtggtgcttccacttttccctttagctaaagaaataggtttactatacatcctcataacgccagcaaagactgttgcagtcattgtacatttgttaaagatattgtcatcaggaaagtggttctcctctacctgcttggggctgtacaaaacgttaaaaattgtgtttgttttttcttttatttaatatgagagagtagttctctctctctcatgattccagtatacatatatcatccttaaaatttgtcatgatctagtaaatttacatttaattcaattcacattgattggagttttgtccttatgacagagcaacgccatgttggatccacgaactataatctgctcagcagccggagccatacaatatttacgttggtatgtaaatactctctttgaaatattggtagctatatcctttttctttctccgcacgtatatacacttgtattgtggatggatgcacgcaaaaccaacgttcttttctattactataattggttaaaaggtaaaaatgatagttttttgtcttataatcacgatagtatttgaaaatagaataccgaaattctatttcttattcagaataagttgtggaccacgttcttcttttcacgtgttttcttccgttcaaggaatttctgtttgtcttttattctaattctagttgtttagtcgtgtcaagtgttccaccggttatggtactactttcttttcattgtaactcatatagctgtaccgtttctaaaagatgataaactcatttggatgcagacaatagagagtagtcccttaggcaacaagattaaaggtgaagctgttcacctctctcagctggtaagcttctcctgtgccagtgatattatgtatggttatgatcaacactttcttcaacactaagagcaactgacattaactacccataatctcttccgcacccgcagaacctcgttgatctggcaggttccgagagttcaaaggttgaaaccagtggtttaagacgcaaggaaggatcatacataaataaaagtttgctgacattaggcactgtgagttttttcttaccacagttttctcttagtcaacaataagttttggagtcagttaaatcgaaggacttcattttcttttaaatccggtcaatctgtgcttgtccaaacctaaagttaaatagttgtctattcttgtttatattctggtcctgtttgaacattctcctgttggctcaattcaggtaattctgttgtgatattgtaggtgatatcaaagctcacggatgtgaaggcttcgcatgtaccatacagagactctaagttaaccaggatccttcagtcctcattgagtggccatgaccgagtatctgtaagttattagatcttttctccatcctcttgctactataaatataaaatccacaacatgatcatcagcagagtgatgtactttactgattagttgtcccttctggatatggtagctcatttgtacagtgactcctgcatcaagcagctcggaagaaacacacaacacattgaaatttgctcatcgtgcaaaacatattgagattcaagccgaacaaaacaaggtttgcctcatatcttcttctatcagaccttattttattgtactaaagttcttgcttggtttctaaatctatattactgcagatacttgatgagaaatcattaatcaagaagtaccaacacgagattcggcagctgaaggaggagttggaacagattaaacaggacattgtaccaattcctcagctgaatgatattggcacagatgatatcgttctcctgaaacagaaggtatgagttatatgctcgattagacaagtggaaggatgttttgtgtctttacattgagagaatctgtagtaaccttgtctttttttttgtttctggctatataacgtgatgatattagctagaagatggtcaagtgaaactgcaatccagactcgaagaagaggaagaagctaaagcagctctattgagtcgaatccaacggttgacgaaattaattttggtgtcgactaaaacttcacaaacatctcgattacctcatcgctttgagcctcggaggagacattcatttggggaagaagaggtagaatcactgattatagccttgatattataaattgtttccatggtcgtttctgagaatattttgctggagcaagtacacaaaattgctagttttgtttggctaatcttggttgataatatgcgtgtgcagcttgcttacctaccatacaagaggcgggacatgatggacgatgagcaccttgatctgtatgtctctgcggagggaaataatgagattagagatattgcgtttagagaagaaaagaagaccaggaagcatggattgttaaactggttaaagcctaaggtatgcaaacgattgaattttcttattagcactgtggtttattctggttcgtttcagaactgcacctagcaactataggtttgtactattgcgcactatagatttatagagttctcatgttcttcaaagaacaatgatataagtaaagagtgctaatcatatgaccttgtgtgcttatttgattatttggtgcctctcttgtccccttttttgtaacaatcttatttttctcctatcagaaaagagataacagttcaagtgccagcgaccagtcgagtgtggtaaaatccaacagcacaccatcgactcctcaaggaggaggaaataatctgcatgcagagtcaagattttcagaaggatcgcctttgatggaacaattctcagagcctaaggaagacagagaagctctagaggacacttcccatgaaatggagacgccagaggtacgaagagacattttcacatatgttatggttccaaagtaactacatctttatcttttccacttcctgccctgttcccagactagcaataaagtgatcgatgagttggatcttctgagggaacagaaaaagattttatctgaggaggcggcgttgcaatcaagttcattaaaacggctattagatgaagctgcaaagtctcctgaaaatgaagagattaaagtaatataaccacttggttcatgatttgtatctagcttccgtttaaatctaccaaacattcactttcctggttatctgtgttacttaggaggagatcaaagtcctcaatgatgacatcaaggctaagaatgacgagattgcaacgttggagaaacaaatcttggactttgttatcacatcacatgaggcgttggacaaatccgacatcgtgcaggtaagttcattgttaagtattatgcagtgactttttttttctgtggttcatttctcaagctatttctctataaatatcttcaggcacttgctgagctgagagatcaagttaatgagaagtcttttgaactcgaggtaaagaattgtttctgctacagcacctagagatgtcttgctactgcgtggatgataattatttctcttagctccagtataatatctactcatgcctgcataaagttgcttctctgcaaataatgatgaaagctaattgcatctataacgtttttttttctttctcattcttgatcttgtttacaggttaaagctgcagataataacatcattcaggaacaactcaatcaaaaggttgagagattttttcttttatcgatttgtcttaagtttataatctgtaaataatttaataaccaacgaagtattttgctgcagacatgtgaatgtgaagcgtttcaagaagaagttgcaaacctaaagcaggaactctctaatgccctggaactagcacaggttctcaaactttttatatgaaaaaagcaacacctaatagctaaatgattctcaaactaaagtcacttgcctttctgacatgacaggaaaccaagatcgaagagctgaaacagaaagctaaggagctaagtgaatcgaaggagcaattagaacatcgtaacaggaaactcgcagaagagagttcatatgcaaaaggtcttgcatcagcagctgcagttgagctcaaggcattatctgaagaagtcgcaaaactcatgaatcacaacgaacgactagcatctgagctagcaacactcaagagctcagtcccacagcacggtaataagccaggaacaacaacaacaaccaatgcaaggaacaatgggagaagagagagtcttgcaaagagacaacaagagcaagagagctcgtcgatcgagctgaagagagaactgaggatgagcaaagagcgggaacgatcatacgaagctgcacttgttgatagagaccaaagagaagccgagcttgtgaggatagtagaagaatcgaagcagagagaagcgtatttggagaacgagcttgctagtatgtgggttcttgtttctaagctgagaaggtctcaagaaggtggttctgagatctctgattctgtatcggagacgctacagaccgatcgatcgttttgagacgtgaagtagtaggatatgtttgtgcagtgattccaagagtttgtgtttgtgtaagtatgataaaacataaagtaatgatttatttgaaaatcatcagattgtttaaaattcaagaaaaaaaaacactgtttaaattaagaggtaagagaagtgaaaagtgggtaaaagaagaaaataatgatagttctggggagcttagagcatgatgattatcccggtctcttataactcatgattttaatatattttttttacactttttggttaaaaaacatctcttatatattttatttaaaaaatgttcttagttttttaattaaaaactaagaaacgattagctaaaaaactcagttaagaaaccagggttaatcatggtcttagtaaagttcttaaaattttcactttcacccaatacctttccactaatccacatttgccccaattgatttccttctttgtgtatacaacccaaattaataattgttaacaaaacagtaaaacactatacaaacaccaagaagtgtactcaatcagatgtctgaaaacaagaagtgcaactgaagagtcttggattgaagttagagaggcttaagagtgttcttaggagcacttatccacggagtgtctccaatggcaaatctccacaaggcattgacatgttgaggcaatgcgtaatctattccaacgcgaggaccaactagtactttctccacatcttctcctccatccagaacctccaatcctcctgtttttcatacatcatttattacaacaaagcttaaactctcttaaagaatcagaaaaaaccagaaactccattaactgattttggtttatttgtctgactaacccggagaatagaggggatgatgagaccactctgttgaaagtccaagcgcctgcccgacctgcaagaggcacatatgaacagatttcatgcattgtggatttgcaaggtgcattctgtttgatgcagatcagactaacctttcctggtccatttagaagaacaggtttgtcggttttctggccacgacgctcctgtatggtctccagccctgcaataccatcacacccttttaagccaacgtaagatctatgtaatcattcttaacgcaaaaacagtatcaataaagcaattatttaagtagaaacatgcatcgataagagagagtgtaatgaacagtctcacagaactgatgtggagagattattaccggtaacaggagaacaagatcgtatcaaaacagcagctccaactccatccttatcagcaacaatattgagcatcatatgaagaccgtaacaaagataaacatatgcatgtcctcctggtccaaactaataaacaaaaaaaacacacattttagagaatgttatcatgtgtatttaactaaatgataacaaagcagaatgaagaaactcacaataggtgcggtccgtggggtattcccgaaccgtccatggcaagctgagtcatttggtctataagcttccacctgccaaaggaggaacaatgttagagagtattaacttcgttaatccaaaatcaaaaattttttaccaacaattatagtcagaatatcaaaaatcccaagaaaacaacaaaaaaaactaaattcttttaatgaggaaacaagaacaaaactttgtatctgacctctgtgatccgtaggacaacattgtctctcctcaggaacttcccgagcaaacgtggcgctagatcaagcgcgtctatttgaaagaactcaggaggcattatcttcatctcgggggtggagcgggtcagtgggtactcgggtctgacccgaaccgcccgagccttggaacagtgcttcttctctcgtgctgcacgtagagccactggagttgtaaccttgggtagttccgattcctgatcaactcgtttggaacgacgaggcggcgttttcattgacggacagaaccaaaagatttttgactttttcgaatgtgttcgactctttgacttttcttcgttttgttatttggcgggtgactgttacgctgtccgaaggttaagccttaaacataaactttccttattatgaccgtcatatcaattttttcctccgtttttcaatatttggcgttttaaaaaaaaatttgagaaaaattgatttttttttgtttatccgatttaaattatatggttactaataatccggttaaaacttaaaagtaaaactatagtttatagataattaagtttgtaattctcaatttgaagagaaataaaataatttatggagagctagcctgaaattataatcggtggagatattttgactttatatgatagtggggaaataaaacacaaaataaataatgttttcaaataaacatttattaattttatattaattcctattctgtaattttgaattatttttgaaattattaatgaataaatgattaagaatatttttttaaaagaaaaattagatataccactctaaaataatacttcctccatttcagaataaatgatgttttataaagtttttgttgtttcataatagattgatgatgttttgatatatttatgttatttttaattttattgaaaaattgtgtaactaattagatattagagtaatttatgtagttggttgaatgatttttaaattatattcttaaaactaacttttagttataaaagtaaaatttttaaaacatcatgtgaaatagatggagtaggatttaacataatttgtacgttctagacacttccaaagcgtttcaaaagttaattagtttttctttttctggcataagtattattttatatttttccatttttcagtaggaaaaaaataaataaaaaaaaaacattttctagaggcttcgtttacatatatctaggtttacctcctctgcttcttcccacacatctcatcgaattcgactagctccccactcaatcactcctcgttagttcaatctcgaatccctaatccactcaccatggcgaagttcggcgaaggcgacaagcgatggatcgtcgaagaccgccccgacggcaccaacgtccacaactggcactgggccgaaaccaactgcctcgagtggtcccgcagcttcttcaccaaccaattctccaacgccgtcatcctctccggcgaaggcaacctcttcatcaaaatcaagaaactggagaagctcgaaggcgaggcgtacgtgaacgtgcgcaaggggaagatcatccccggctacgagctcagcgtctctctctcctgggaaggcgaggcgaaggattcggaagggaagacgatctcgaaggcggagggggccgtggatatgccgtatatctccgatgagaatgcggatgaggatccggaggttagggtttcggttaaggacgagggggcggttgggaaggcgttgaaggaggcgatggtgaagaaggggaagggggttgttttggagaaggttagggtttttgtggaggctatggcgaaaggagggccttgtagggatgaattggagaataagaaggtggctcctaagtgggtggcggcggcggcagcggctgtggagaagactagtgttttgcctgctgtggtggtgaaggagaagaagaaggtgaagacgaaggaggggttcaagacgattagtatgactgagaagttcagttgtagagctaaggacttgtatgagatcttgatggatgagaataggtggaagggattcacgcagagcaatgctaagattagtaaagatgtgaatgggcctattagtgtttttgatgggtcggttactggggtgaatgtggagctggaggaagggaagttgattgtgcagaagtggaggtttgggagttggtctgatggtcttgattctacggttagtttagttgttatttttctttgtgacctttggtttctatgtcattgtggctgatgtattgtgctttgacattttcaggtgaagataacttttgaggaacctgaaccaggagtcaccattgtcaatcttactcacaccgacgtccctgaagaagacaggttagtgtcactgcttgaaatctttcttataatagtatggtagtatgcaatgaatatttatggtgtttggagtgcttgatagcttggtcttatatataactttcatattgatgtactatcttgagggaattgtaaccacctttagcctgttttgttctcaatgacagacactaattctgaccttagtatctgtgctaatccttgcgactgtttagcttgctgtatgtagttgttggactcatccagtctttgttctagtgaatgaactcttttggaatttgggttttgctttatttgttaatatatgatagaacatttctatctctaaatcgctcaatggcctacacgtctttaaatcttctacctatgctacctttccactaactagctttaggttatgctgatagagcgcttctttgttccttgtgaacacctgttggcttattcctgaaagtatttgtttgtccacattctcttactcgtcctgttgtgaagtgattttgtccgttactggatgtgacttatttttctctgacgtttctactggctgatgcaggtatgggaatgcgactgtggtggaaaacacggagagaggatggagagacctgatcttccataggatccgtgctgttttcgggtttggaatgtgatttgtgattttgattatcaagtaatcaaaatcagcattgcttcatccataagttcgattatgatttcaattcacaaggagacataaagacgatgcagaaatttggtttttacttgtagtttatgcattttccatgaactctttggtcttttgttaacactatttggattaatggcacacaacaaactattcacatgagaataagttgttttaagtgttttattctaaaagtggtgtccatagtcaaccacggcatcaagattgcctaaggaacattgtctaaagactgatgaaaactaggaacaagaagctttggtttggaactataagctttttgctaatcgcaatgcctaaccaacaagttacacatcaaccggtaattaaccagttaccagaacctgctttgaccaaaatattacacatcacagcaagctctttggatcgtttatctaaaagggttttggtttagcctggaaccacgtggatgaaatatttattaaccacaacatcaacagaaacgtttttactagctttgtcaggtatagacgtgggcacaaacaagacctacttgaaatcagcacctacaaaataaaaccaaaaaacatcttactcttaatgtatggcggtctttaagacaacaaaaatttcttctaccacttttaatcatcaagaagagacttgaaatgttacagattaaggtatcaagctcagactcttaaaatgtcatattgtcagtgcatatgatttgaactagattgtaatatttaacattaagaatttagttatggtatacagagtataacggtttgtggatctgtcattgtgttatcattaagctttgtaaagatagtcattgttttggttttgttaaaatgatgttaggtagaaaatagtaataatttcaaatcagcatttagtataattatgaaacttcacaaaatcgtgtggaaaactattaaagacgagttttaaatatggttgaccggatagttaattttcttacatcagatccaagattagtattccgaagattgttgcggttactggtatcaatttcctggaagatttaaaatatcatcatgtcacgtacttcattactagtaaccttcgttgtttaaagcggaaatgtcgcaactcgtttgcttcattttgttttctttttggatccttcaaatgatccgcaacacttccgttggagttgatgccatagagagtgcgtcgagttatttaacgtataataaatattcttgcgtccttgtacacatcatacgttaattaagccatcaagatgtagcattactggcgttgtttcagtaaaaaaaattattggtaaaatattaaattttaattacgcagaaacaacaaagaagacaggaaaaaaaactacaaccagagactatgttacaacgaattcaaagagaaaaagaactgagaagaaaagcacacatcttcgtcattcaaaaattaaaccgtttattgacaaagaaattaatcgtgactaataagctcctttgtcggccccatgtaacccatcttttacgtgtaatctgatgcttgcttccacggttccaccccgacttaactgccacatatacactttggtcattcaaacttaccaaacacaaagcgaattcgtttttgtttcatgcttttaagaatcacaatctcaacattccaaatatatataaaacacaatctcaacattccaagcatggggtggcattctcgtagttatctccatgacaaggggcactttacaatagaaaacactcgggatacttttttatcgacgattcctaagcaaaatattaccgaacagacacctctctgtctgtctcttttatatgtcttctcaaaaacgaaaaagtctcttctccgtcaacatttcactttccctctttccctcttgttaatctctctctctctctctacactcaaagaaaacacagagactcttcacgcgccaaaaaaaaaaactcaccaccttcctctctcccttaccatgacttcagactctgtcaagcatacttctatccacggcggaacaaccatctccgccgcatccttcgaattaaaaagctttatctccgccgcgaaaccaagaaaagcctcgacttttgtatacgccttcgtcataagcttcgttgccttcactgttctcttagtcttcacaccttctcccatcaccgtctctcattccattccttcatacatcctccctaatgtcactgcctccttgacttcaccgtccagtttcaccggaaacaccccattgccggaaaatctcactccggcgccggaaaatctcgctccggctactaaaaacgcaacctttgagtctcccatcgctaatggagcaaattcacttgcttctcagccccggaccgaccatgcattggacaacatgttgtctccggacaacaagactaatgatactgctccaagttccgacaaacttggatccgcggaagcacctctgtccgaaaatctaaccgtcaattcctctgctttaaagaagagaaaacagaggaggaagtcgtggatgagacgagagataaagtctttaaagaactgcgagttttacgagggagagtgggtgaaagacgattcgtatccgctttacaaacccggttcgtgtaatctcatcgatgaacagtttacttgtatctccaacgggagacctgacgctgagtttcagaaactcaagtggaagccaaagcaatgcactttaccacggtaaaggataaaactttgctttttaattttgactttaaaatctatttctttgtcttatatggttggttgatgtttttttttttttgaaaaattataaaaggttgaatggaggcaaattgctggagatgattagaggaagaagacttgcgtttgttggagattcactgaacaggaacatgtgggagtctttggtttgtattctcaaaggatcagtgaaagatgagagtcaagtctttgaagctcatggacggcatcagttccgttgggaggctgagtactctttcgtcttcaaagtaggtttcttttagtaatctaaatcagtttcattagttgttgtctctcgggacttgatttgtatgtggttgataggattataactgcactgtggagttctttgcatcacctttcttggttcaagaatgggaacttacggacaagaacgggactaagaaggagactttgaggttagatgtggtcgggaagtcgtctgagcagtacaagggagctgatattcttgtgttcaatacaggacattggtggactcatgacaaaacttccaaagggtaatagagttctgtcagctactttgatccttgatttgagggatctgtctcatttgttatgtttggatgctttcattagggaggattactatcaagaaggaagcaatgtacacccgaaactcgacgtggatgaagcttttaagaaagcattaacaacttggggtcgatgggttgataagaatgtgaatccaaagaagtctcttgtcttcttccgtggatactcaccttcacatttcaggtatatacagatctcattttgtttcataatataggtagttgtaggcttgtagctaaaagcacaaagattaagaacgttattattttttttaaagtatcatctaattttatagtttagatatatcttaaaccaatcataaactagtctatataatttgactggtcacactatatccaataattcaataaatataaaagttaagtagaaatgtaaaaactacataatcttgaaaagaaaaaaaatattcactaaaactacttataatatgtgaaatagagggagtataaaaagagtgtttctaaaagttggtttggtttggttgcagtggagggcaatggaatgcaggaggggcatgtgatgatgaaacagaaccgatcaagaacgagacttacctaacgccttacccttctaaaatgttaatacttgaaacagttctaaagggaatgaaaacgccggtcacgtatctcaacatcacgaggctaacagattacaggaaggacgctcacccatctgtttataggaaacataaactatctgcaaaagaaaggaaatcaccattgttgtaccaagactgtagtcactggtgcctcccaggtgtgcctgattcttggaacgagattctctatgctgagatgcttgtaaagctccaccagcttcgtggcaatagaaggcggaaacctaaaagtttataggagttagaatccttttcttaagatgatgaatacagatcttttaggaaacacttagaatcaattttcacttttcagatttgtgccactgaaggtgtagagaaagtaagagatgggagtcacattagtgtttcatgatgtacgtacgtaagagatgagttaatcaccttatgttgctgcatttgtagtcaactacaactagtgactcatttttttgtgaaaataaaagattgagccaacatttgtataaattccaatgcatacccctttacttataataatgatcaatcgattggtcaaacgaatacatttagaattaagaaccctgcaacgactttggatttaaattgacacagatcttttgcttcaaagtaacagtttgagctaagaacataaagaatgcaccagtcctttaattacagtattatgataaaactcactagagccatctagatacaatctgaatgataatgtcacaggtggaaagaaagcatgaacatactcagtcgtccttcatgagactcctccggtcctcttggtgtgcaaccaaaaccaccaccatccacgtctttcgtatctcacaatgttatcagcagccttatccaagtcctcctccttcgcgtcagttccctctctctttctttctttctttctttctttctttctttcttgagattgcaagtttgaaattaagctcttatagattgtttattttgatgttgttatgtcggtctctgtgtaaatgtttagttatttttttcgattctttctcagaaaagtgtctcgaccttaagtattttcttgttagagacttagagctgctactctttgattctcgtaagatttagtttcctcagttattgctttaagcaagcgagagactactctcttgactgttttggccttctgatttgttgaatccatggcaatatttgtggtttttgtctcctgctctctctctctctctctatgtggatgggctttgtttcatgttactattattagctccaccttcgagattattattctttttttttttttttttgaatgaatgttaaattttattcaatccaaaaaaacccttgttacatttacaatgtttcctactccaattgttttataacattatcacccctatttgaatttatctactcaagaaactggtcttgtggagaaccagtgttgtaaaccctcctgccatctatcatcccctgctctttgaatagacagaaatctattcctcactcctctatcaatcagccttatcatcgtagtagtcggctggggagcttcaccatgccttctaccattcctctccaaccacagcccatgtatagtagcttggaacacatacttcaatgtgaatgtcttgatagtattctggtttgtagatatcagagctactatttctgaccagtcacaagtaaactcatttcccatcaagcctctcaccaagtttccccaaacttctgccgaatatccacaatcaaagaataaatggtttctggtttccaatggatcaccgcagagagagcatgctgtatttacacttcctccccatccttgcattctctctcccgttgataatctgttcttgattgtaacccacgcaagaaaagcaaacttaggtgtcgcaaaagtgaaccagattcctttactccactcacagcttactcctctagttcgcaattgactccatgtttgcttagtagaaaacttccgcttgaatttgtcttccttatacctccataatccaacatcatcttcccttgatgccatcattttacatttatctatctcatcctcaatcaagttcaaaacagggattctatgtcttctccttcgatgagtgctcattacttcctctacagtagcgtctttatggatccccatatccatgtatcctctttcaccagctctttctaccagacaacccaaatctgaccaagcttcatgccaaaacgaagtttgcttcccactcttcaccctcaccttatagaaaccttttgccttgtctcaaagagattattatctcttccatatggttcagtactgtttagtttgacttgctttgtccgttgatattgttagctagctaggttagaggactaatttataacccccacatctttaactgttttctctacaaactgttatataggcctggccataatatccgtaacccgaaatccgaaccgaacccgaaccgaaaaacacgatccgtatccggtccgaaatgtaaaaaatatctgaatgagtcttgtaaggtggcacaaaacatatccgaacccgaagtgttattaaccgaacccgaacggataacccgaaaaactgaaaaaaccgaaaattccgaaaaatatccaaaaaaaccgatctgaatgtccaaaataatatacaatataattatataaaacatgaatatatacttcaaatattcaatttcatatttattttgatatgttatctaacaataagtatttaaaatttaaataactaccttaaatacttgattatatataaataaatatatatttttatatttacctttaaattttagattttatttcgggtatatccgaaccgatccgatataacccgaatccgaatgatatatgattactttatgggttgtgatacaaaaccgacccgaacccgatgtgttatatcagaacccgaccgtacttgcaaatttactagaatggaacctaagaagtattataagagagaaccaaaatccgaaaaacccgatccgaacgccaacgggtacccgaacgcccaggcctactgttatatatcaataatttccgctttcaaatttttgtttgatgcagatgaatttgaaatttctttgccttacgactccaaaacggtgactggatttgttggattaatcaacaatcaatgtggtgaaaacgcatatgcgagtgctctcattcaaatgatgtttcacattccatgcttttgaaaagctatcttagaaattccagagactatccctgtcaagagtctcttccactgtcttgagagcagcaagactactgtttcattagagagcccagacataaccagtaataccctgaaaaagggtttattttgaaacagtgaatgacaagatgaaagtaagttattttttgcataaccttatagttcacactgtagatgctttgatgtaaattattttgtaattacaaggctcacattggaagatttgtaattctcggtttgagtgaaatatgtgtattttctgcaactaatgactactccaaaactaatactttgtgtccaacttgtgcacaatgtaatggtaattagtcgttgaaaactaacatatgtgatttaacaataaattcatatattaacaattcaaaattaatttaaagctttcggatcccaaactatgctgtcaataatcatgtccaagtcatcaatccatttgcgtaaggttaatgagatatcaagaaaaatcaaattcgtaaatttttttaaaatatggttgttacttctcacacactagagcatcgtccacaaattccttagaaaaatttagtgttctgatcgtaatttgagtctcattgcaatcaggaacaagctgaaatctacttattttttattgatgctacctcatgtacttcattttgtttggcaggtgaaccagatgtatgagtgtatccttatgaaatagatctcgagaagtttcttctaaccactgatgctgatgggacaaatcatttcacttacaaattgaaaaggtaaactgtgtgttttgtttgatgtggttgagaaatagtagacacgcaccagattcattctcaagacacagcttcatcttcagaaacagcttccctagaaagtctaatgtggtcatcgagagtattcaccattagttctcagatgattgatccatcatcacaaactcaatcaaaactctcttctttgtttctggcatgttgatataaaccaaaacaagagactgaaaaggaaaaaattcaaatgccagctatagtgaacatagacaagagcatgaggaagttgaatgatatagctttgtagcatattttctgccatcagaatgtaccggacatgcttgcctgccatcatatcatcagcattttaatttagacccaacttgcttcacaccagactctcttccacatgatttttatatatatcttctaaccaaaaaataggacagaacaaattaaaaaaaaagtttcatcgggctgttcttgttaaatgcaatgaaaacaacaaaatctaacagttccccattgtcactctttaaggtgacttgtttagcctttactcacctgaaggaaaaaaacaactactataacggtgatgaagcaagttggataaacaaaaaaaagattggaaaagggcaaaacttatagtgaacattgcacccaaaaaaaaaaagttatagtgaacatagacactaaaatgaagtatctagctttcttaccttttctaccgttagaatgtacgggacagcttgtcagctacgagcttgtctgccaaactttacaatgtatcgttctattggttacataacatataaaaatgaatagacagagagacatagaaccgagcatatgaagatgagagaaacgaactaacctaaattaaaccagaatgttaataaatataatccaggaaaaacccgaactaaactaaattgaaccggtagagaactcaaaaaccagaaaccccgagtttatggaaacttaaccggatgaatcgaatccggttcggtataataaaacccagaagaagaagataaaccttttcgcagtttgcttctttctctgctcaaacacgaacaatggcgagtctacttgactcactcacaaccagaaacttcttctctaaacccataatctctaggatctcctctccttcatcttcctttgcttcttcttcttcttcgaatatctcacccttttctcctccctccgttctctcttactctcacaaaaggtcgcattctcgcttcccttaccctgtcgcagcaactctcgatggtccctccgttgaagaagacgagctagagttcgaggaatccgaagaagacagctaccctgatgagtcggatgaagaagatgacctctccatagatatctcaattcttgagaaagaagcgagagatatcgttagagactacgctactactctgtctcgcgagctcaaactcggtaaaagattgtgtctttctttttgcattatgctccattgactgttgaataatgatcgtagcttgatgttttacagaggatgatgtagttgaagggaaggagtcacgtagaaaggggaagaggcaagccaaaaatgttagtcttttttcagtaaagtctagtcctttgagcttgagatcttctttaagtagataaagttttgattttttttgtttggttactgacatttactctaaaaaaaaaagaaccagacgcagataccagagcatcttctccaaagagttgctatcgttggaaggcccaatgtgggcaaatcagcattgttcaaccgtcttgttggggtaaaagagtttgactgttttctccttacccattcaagttttagagagttgttaacttgtccttaatataattgcaggagaataaagcaatagtggtggatgagcctggagttactagggatagactgtacggtagatcctactggggcgaccaagagtttgtggtggtggacactggtggtgttatgactgtttctaagtcgccagctggtgttatggaagagcttaacgtttcgaccaccattggcatggaaggtataccattaagctccagggaggcagctgttgcgagaatgccttccatgattgagaagcaagctacagcggctgttgaagagtcagatgttattgttttcgttgttgatggccaggttcggttcttatcttcaatcttctctacgtttatgtctttggcttattaattattttggctgtcatgcaatgttgttgatgggtggtaatgattttttggtactcgatcaatacgcagacagggcctacaggtgctgatgtggagattgcagactggttgcggaagtattactcacataagaatatcatcctcgcggtgaacaaatgtgaatcgccacgtaaaggactcatgcaggcttcagagttttggtctcttgggtaatttcactttcatcctaccctcagaatcatgtttgtgcacattcatagttttcattgatatttcagttgcctacaaaaataaaactcatggataaacgtcatttggtacttttttatcagatgatttgaatatttgttgctttgttgtgttcacatttaacaaaaaatttgttctaattttacggatttagtattgttattttgatgagtttgtagacctgacgatacttgtaagcatcataaaatactttcctccgttgctatacatttctttgtcaattttggagattatttggcattgagcttaacaagcatgtcatgatggaacttccaggttttcacccatccctatttccgcattgtcgggaactggaacaggagagctacttgatcttgtttgttctggactaaacaaactcgaggtttgtatgtaaccttttagtatgttcaactggcatcagtttaccaattatatatcaaaaccaatgattttttttttctagatcatggagaccatggaagaggaggaagaagaaaactacatacctgccattgcaattataggcaggccaaatgttgggaaaagtagcattttgaatgcacttgtccgagaggatagaacaattgttagccctgttagtggcactacccgtgatgctatcgatgctgagtttaccggaccagatggagaggttagttcaattttttctcgtgtttgttgagctgcttagttttcttgcggcttctatgatacagtgcctgctgtttcgctatatgctaattggcatctatttgatgcgctttccatgttaactcctaccattttttctcaatttggtttggctactatcatcaatgactagcattgtccaagttgaatattgctgaactctgaatatgagcagtgttcaaaggtgcattggatccgtataacactgaaaatgatttatgaactgtgttgcagaagtttaggctaatagatacggctgggatcaggaaaaaggcagctgtggcgtcatcagggagcactacagaggccatgtcagtgaaccgtgcattccgagcaattcgtcgttctgatgtggttgctcttgtcattgaagccatggcatgcataacagagcaggtatctcactagttctaaacaatgtgggaaacgaactcatctttctctccttccttaatggtttcttatttggaaacacaggacatgaagatcgcagaaagaatagaaagagaagggaaaggatgtctggtagtagtaaacaaatgggatacaataccaaacaaaaaccaacagactgcagcacactacgaggatgatgttagggagaagctccgttccctcaaatgggcacccattgtttattctactgctataactggccatagcgttgacaagtacgtctccttccaaagttttataaactaattcaacctttacatttttaactttattctgttggagaaaaatgtagtattgtggttgctgctgcgacggttcaaaaggagagatcaagaagacttagtactgctacattgaaccaagtgattagagaagctgttgcgtttaaatcccctccaagaacccgaggaggcaaacgaggccgcgtttattattgcactcaggtgaataacgataagatctcccaatgtttttttttattagcagtgaaggcaaatctttggagactaattgatgtgattaatgcaggcagcaataaggccaccgacatttgtgttctttgtaaacgatgcaaagctgttttcggatacgtacaggagatatatggagaagcagctacgcactgatgcaggctttgctgggactcctattcggcttctttggcgcagccgtaagagatctgacaaaaatggaggaggtacgtgttttgctagcgtaaacttgtgattcattttgaaaaatatgacaatgttttgtatgtataactttaaatgaaatttgcaggtggaggtacaatgagaatgtcaagtctttcacgtgagagaaatcttgcaacaaaaaggtcataatgttaagtcatctactcatctttgttaaattttgtgtattttttgagaaataatgtattgaaattcgatattatataaattcatagtttgttcaaaaaaaaaaataaattcatagtctctgactctccattgatcttccatgtatgttccattttgtttctttctgagaatcaaaacaagatattactaatcttcttgacagtttatagaaaacagaactacaacgtttctttatgtttatgttttcttaatctcaagctgataaaaaaaagataaacagaccaaagcacaggcgatgagtctcttagtaaagctgctctttcttttcatgccaccatctccacctgtaatagaacaaagaaacacgaaactatctttgtcaaaaacattagaaatattcatttttgtcagaagaaaaaagtgaaatgagatgatatatgataatgatataagtctacgtagtatacgtaccagtaatagtcccaacgaggacggactttcgtcatgcggttatcatcagaaggatgataaggatgagcggcgtggcgagtgttgtggaaggcgcagcaaccagctgcatagacagcgatgaggaggacaaggaccagaatattaacgaccgacaactttttccagtcaagacggatctcctcaagaacaccagctttgcaagcatcacactcgtagcataacgtttcaataccattgttccatctatagcaatcttctcctcctactattactccggtaacgtacgtgcacgccgtcggtggcttacaacatcccgactataaatcaaacacacacatacaaagttgatgaagatgctagcttacaccatagggcaatgaatatgagaaaatattaatgaggatcatggcagtcttttagcatgtgtaaatggaaagattgaaaatggtttgattttttttttaatgtataaattggagtaaaatttaaaatttaaaatatatttataaattaatacttataatttcaaaaaaataacatatataaatggagttattaatacttataaaaaaaatctacagttaataattttattgaacatggttctaggcactgaaaatggtacctgaacagaagtcatgtctctttggaagtaatcaagtgtagtccaagattcaatctgagcacaagtcttggaactcaagatacagcttcttatagagatccaatactgaggatctctaactctctctctcaaccatggatgataatcaccgagcctatactctttataaaccctccctggtacttccacaccgcctccttggctcgtcaccaccaggccaaacagagttagacccataagagtcgcgatgaggaagatcatgaccactaggtaaacccaaagagcccatgccacgttgaaacaggctcctatgaatccggcgagagatactaagagtatgatgaaacctataacgagtagaggagtctggaggaagttttcgcaagttgtgctgcttcttgccttccatagagcggctcctatgattggtattgaagctagtaagctgaggaggtttaagactccaatcactgtgttgctgaatctgtacatagtagtagtgttatcaagaagaaaccagagacttagcagtgccttctcttatatctcgctcttttgtaataagcagattctcttcttgcaatgtgaacttcatcagctttatcttacaatcttctttgttttttagttattatattggttaactctaccttttttttgcttttgattctctcttatcaattgggaattttttaagcgaaaaagtttagagttaatggtttgatgattcatgctcatattctctggtcgtctcttgatttgaatcatccaaacaataacattagaaatagtatttttttcaaataaaagtgtctttttggacaattggttcttgtttattattctattttatacgtttaactaacaataaagcagaccaaaagtagtgccttaattaaaatatgatataccatattattagatacatttttctagcttagagtccaaaaaatgcaatcatggattatatagtggatcatatcatatgtgggtattgtatactttgaaattgttgactcgttacgggaaataattgagatactttttatatatactagatcctttctccgcgctacgcgcggataatatatttaaatttgttacatttatcatttttatttgtatgtaaatttttctatattaaattatatataactaatttttaaatttgagtttttttatatttttagtttgaagtaaatatttctattatatgtaacacaattaactaataaaatatgaagaatcaagtctgagattttaaagttatgtaaaaaatatataattatgtatagaacacaaattatcttagtttaaaagatcggaatctcatctcgaataaatttacgaaaaaaaaagtactccaataacctacttaaaatataaaaactccttttaaaaaaaaagcgtacttaataatatttttttacatgtaatagttgaaaactaacaattgaatatcgatctagaatattattttaatatatctaatgtaaaatattaattgtaataaacaaattttgaattttgtaatattacatgaattagaagtctttaaaatctaaaatctattttattaacatactatattttttattcatttattattttgacgttacaaaatattgctttagttttatttgtatattatttttttaataatttagtttctttttaagtaattttaaaattatcaagaatgtaatatatttaaaattatttatttaaatatatccaaatataatgtctcatttttatgtgtgtttgcgttgagcatatttaatttgtaatttgtatatttaataacaccttattgcgtgtcgttctatggttttaataaatgtgttgtcatctcatttttattactactaacatgattttttagtgatcaatgataatgtattttaaacgttatgtattatattttattgtatattttttaactcttcgtgctggcactttttttagaatcattttaattagataataggttttaagatgtaaataaaactgtgtatgttgtaaatttagacttcttagtgtagctgagcactatcaattatggaaattatattatgattttattttacaaaatctttttttctgtgtattttttttgttttattttgtatttttaaaattttattgcattattctttaactgcagagaattgatatttctaatttttgtttcatataccttaaaagtcttcggttgatttttgtttgttttctttctccaattataatgtatagttcgaccgtttcttctttttttttggatcaaactactaatatcatcagatagaaaagcttaaactctaagaattgagtgaatatttgtgttagagaaaactgatttaaccaataatatagtgagatattataatattagaaggtatggaaactcttctatgttgtcctacgctggacataattaagttgttgtcaattgattttatatttgtgataactggaaatgcatctttatgtcttccttacatcatccttaattggtttgcggttcgactatttctaatatactgagagtaacataaaattagatgttgattatctcctcccaattaggaatgcacagaatgagagaaattcaagatgagaccagtttacaattttgtcctcatatctatatagagttagtttatagattactctatttgtttcaaaatgtaatcaatttttattaaaatatgtaatatttaaaaattattactttagaaatctgtcatttaatatataaatttaatcaattacacagtaatttacataatttaattggctacacaatatccaataaatataaagttacattgaaatataaaaataatttatatagtgaaacaaaaaatacttttaaaccattattatattataaaacaaagagaatatttaaattatattgaacattagaatagtaaaaatcagaaaagctgaaatctcaacgtcgatcatttacgttggctatgttattaactttgaagataacgtgaatgatcaagaacaaaaaagttaattttagcttcagtcatttttttataatcattttaccaaaaagaaaaaaataacaggaagatgactaataaaaaaagatacaaacagagtactgtaaaaaggtgttgatcataatagcaaacattatagtctcaaaaattgtcaactttatattaaatattagtcaaaaataataaaatatataatattaataaattttattttaaatataatttaacttttaaaaattttatcattacacatggtgcagaaaagcacctagtattatttgaatttcaaaaactatctgatgcactaactttttgtgacaaatcaaatttaaggaactgggcaagagattgagaagagggatgtggagaggtacaaagagtcttcacttgatgagttataatggagcattgaagtgccattgttgtagtcgtaagagttacaccggtgaagttgggtagacgaacagatttggagtcgctggagacgtctgaggcaagtaggctaaagaaaaggaagctataagttatacaatgggctggctattttgatggttttagatggttcgagacccatcatctaaacattcgcgatgacgtggcagtttgattggtagagaatattttatcctatgtggcattcctaagaagcttcaaaattagtagcttttatatagtaggatcttgtgttttaatttagttaaatccaaaaatttattttcaagttccattaataatgttcatgtgcatgtagtcaattagtaaactaagttacaattttgtatgcttactaattgacaatatgtttaccaattttgtgtaacgtttagtaaactacgttaaatttacaatgacccatgaagcgaacgagggtaagcaaagaataatagacatggacggatgaatttgctttttaagatgcttgtgctgtcccatccccataactttcagaatattaggttttgtaggttgatgagcacaatatgatctttgattcctccacttcgcttttttgtgtaagcaagaagaacaaaaaaatcttgtttcagctgacaattttacgtaccaccgttttgattttacattttgcagatgattttttgacaggaaaaagggtttttttttaaaacaacatttgagccaaaagacacacaaacttgaaaggctaaaagagtttacaaagattgtggtccttgtgtgtgtggttcaaaagacaaacgggaaaaggaaaataaaatgctaaataagagtataacaagaaaatcgcaagcttgaaacaaagtgttatcttcctatagaaccataatctctactagtatacatccaaaatcctcagtatttgaagacatagaagcagatgctgctcagttgtactcagtttgcaaggtcaagtcttgtacacccaagtcatggtatacatcatacacatattgcagtaaaggcctttcatctatcccgctcttcacctaaacacaaatacccgaaataaccaactcaacatcagtgccgttcttattgagtactcatgttttaaccgataagaaaacaggaaggaagctagtacctggattctgagtgagccaacagtgtgaccaggcacaacctcccaaaaacgagcctgtaaaacctctatgacatcctctcgagaagtaatctgtaaataaagagagttgaagagaaacccagcttgatcgatctatatgtacacgttcaggaaacactttatggaacagagcgaacctgacgcaagcatttacttaatgcggaagaaggaatgtttggaggtgccatctgaagcaagacaccaccggtggctttgaagagtggcataacaagcataaacactgtaacagataccaatcccaaacataggacctcagcattttcaaccctgaaaaatccaaagaccggaggagaaaaatggaaaatgtaagaggtcaggtactaagacatttttattcattttgttccttttaaaggaagcgagcattacccgagagagaggagccaggatgccagtatcagacctgcactgaaaagacagaagcaaagaatatgtcatgtgggatgtatataagtttcatgcaaagagaaacatttttccagctagctctccgcggctctgcttgagataaagaaagccaaagagaatatcacacctgcggatggaatctgatatgacatgcaagcaaacggagtggtagttcatatcttctgcttttctgtacactgcatcattttacgaatttaagaaacacattcaagaaaaatgcaatatgtacgaagggaacaattcttggccagatcagttgctttcatgctgtctctctgttttcactaatcctcctacttattctatcttaattggaaacccttgcttctttgtggctttacattgacaggggtggccagtttttacaatgaaatatagcaaagccgccaaacaaggctataccatataaagcaccagtatcggtattagttaattcaagtctaaccagaacttaagcataataataaaacagagaatacataccaatattcatacgagcataattccggaagaaccaaacaccaagtaggttcaccagcagatttgttaccgctgatacaataagataatgcctgcatgaagtcgatttcagtacatcatattaatgcaaagaacttagtgtaaacttagtaagtgctagagaaataactacaagctcttaggcatgtcacttgtggaaagaaacttacttgtgctctgattcatcttgaacaaatgcatgaagagcttccacagctaaggagaacgacatgaacataagaaacagctgtctacacatatgtcaatactgaacatatcaatgtgttaacccaaaagataaaatgaatgagacagtgaaggcaaaatgaaaagataatcaacattttaaacgagctgtaagattattctattctatcaacaacagtaaaggaaagtgtgcaaacactatcgacactattttctgaaagatattaagccagttttattgcatggcacatcagccattagaccctcaaattaaaaccggaaatgacatccaacaaacttaaagaacatacttacagcattagtgaaagcagaaagaacttcaagtcttttgtacctggaagaaaagccaacgattactaagtcacaactgattcagcattatgcaatgtcagtatcagcagcaaagaagcaaacagacaaggtttcatatttagtaattataaaaactggatcctatgaaaacaacggcggatctactttaggaatgctccagagaaagaaaagaaaaagtaatttaacaaattgggaaatcaaccgtaaagtaccacaaaccatgcattccaacatatatctccagcaaatacaagcaccaactaatcggatcaaatttgaaaaatttctcacccgtatgagtaagcatgatcaggcttcttccttgaagtcgccattgcaaataaagaaaacgtcaggagaccacatccaaatgtcaaatggaatgcatcagaaaccaaacctgcaagagtcacatcaaacatcaaacatcaaaaaagagagcaagtaaacaacaacagtaaacatgggaatctaaacaaatctcaaaccaattttgatatttacaaaacctcagctgcaacagaagacaatatcttaaaaattaaaactccataaccaaaaggtctctacatacgcataggatctactatccatgcggtttagttcccaaatttaaaagattatattaaccaaaaaaaaatcaactttagctgttttgtttcatctaaatctctagtcactacccgaagtaaggatgtgaagctcacatcgacctggagtcttattcctccaacaaatccaactctctccctctaacaaagttatcaagaactaaaaccaagcaacaaccaaatcgtacctacacgcccagtcaatagcccaatcaacagctctgtagtagagtacgccacgttaagcgaaatcaacataaacaatctcttcatctgccgatttccatttctcagcaccccaaaaaccaccaaaaccatacgcaaaaccgacaccttcccaatcgccgccgccgctttcccttccccgaagaaaacatcatccccgtcgacagagtatatctccggcggcatatcgatggtggagaccgtcctatcgagaaaaggcttagccgccggcgttcgcgggccgtgggagtggtgaaaggagcgggagtaagcgagcctccgatcattggcggcgtatccgacgtcgctgctccgatcattcgggagttcgttatcgccgcgaagatcgaaggaaacggatctctccatacttagctttctgtttgctcctcaaatgtgtaattcaacgagtcttaaaagtacactgcgtctactagaatgaccttaatgggccactgatgtaagcccatataagagctcaagtcatgaagcgttgaccgcatttaacgccttattggacttgattgcctctcgagtagggcttttaacgccttattggacttgattgcctctcgagtagggctgggacttttaaccgaacccgaaccggatccgactcgaaatagaccagttcggttcggttttggacatggccatattatccaatagatcattgcttctaatatcacgggtcggttccggttattacccaaaacctgatcaggtatttatttaaaccaaaatggatagtgtaaaacctagaatattttaaaaagtattatcaccacgactcaaacccgggtaaaagtggctatgttaccaccagaccacttcaacttatatgtattcttctatattgtaaatatctatagtatttcaatattattttttataaaattaatattttagagattttgaatccgggttggccacactacaaatagagtatgtaaccactgaaccatttcaatttacacgtaattattttatttaaaaaatatgtatatgatttacataataaatgagtacccgaaactgacttggaatcagagatatccgatccgaaacctgaaccgaaatttatctagtacctattggatagataattcatttatctgaaagatccagacccgaatggatcttacccgacctgatccggataaccgaagtcccggatctactctcgagtcttgtgatatgttttctcccataacaacaaaaatacagtatagtataatacttcagataaataaactttattaaaattagtagggttaacatatcacattcaagcatttttcagcccgttaatatcaataattaactttttattcaagcatttttcagcccgttaatattaataactaatttttggttggatttgtctctttaaggaggatttgtctcatgatttacaaataacaatattcatatttttagtctcgtaagattttatactacaaaatattaactattataatttataaataatacattatttattattataatataattatctagactgtttgtaaggtaatcacctagagctttagaacactttcatagtgatgtggaatcattgtttcaggcattgtgttggattctggagatggtgtgagtcacactgttccaatctacgaaggatatgctctcccacacgccattctgcgtcttgatctcgcaggtcgtgacctcactgattacctcatgaagatcttaaccgaacgtggttactcattcaccaccacagcagagcgtgagatcgtgagagacgtgaaagagaaactcgcttacatagcacttgactacgagcaagagatggagacggcaaacactagctcatcggtcgacaagagctacgagttgcctgatggacaggtgatcaccatcggaggggagaggttcaggtgtcccgaggttcttttccagccgtctttggtcggaatggaagctgctggtatccacgagacgacttacaattcgatcatgaagtgtgatgttgatatcaggaaggatttgtatggaaacattgtgcttagtggtggaaccacgatgttccctggaattgctgataggatgagtaaagagattactgctcttgctccaagtagtatgaagattaaggtggttgctccaccggagaggaagtatagtgtctggatcggaggatccattctagcatcactcagtaccttccaacaggtaaatcatcttttctgcttgttactcgttttgtaagctgactatgatacacaatgttggtattgcagatgtggatagcaaaggctgagtatgatgaggcagggccatcgatagtccacaggaaatgcttctaagattacgctcgccgttggatgaaagattttttcgtattattttatatgttcaacgagttggtttcagacaattttttttctttggtttttcctcactacaattgtttcttgttgtcacactctctttggttgtttctgccattaatgagaaaaaaaaagattcatttgtcttattttcttttgttccctcacaaatctgaaagcaaataaatatgaagaaatgaatttggcttatgttgacaggtttctacaaattaaaagagaagaatagagttttttacaaagagactgaaccacatgagtagtaaaggtgatctgccaaccaaacaacgcaataactcaaactaacttaactgtaacgaagattagatttatggttcacttcaggtgagtaaaacatttttcttaaagcattggtatgtcttgaaacgacaagttgctttatgtcaagattcactagaacataatagtagtttcagaggaagctaagccattacactgttcagggatccacattaagatagttcgagaacaagagttcactagtccgaaagtcacatttcaacgatcccaaacataacagcgatgagaagaagaacaatacagacacaagacattttagacactaacttccaacatcacataattttagccaaaatgtcagaaaacacaacaaaatggataattaaagattattgaaacagaaacatagcttcttaaaacaaagacaatcatagatgagaaaggttcagtttcttctttgcttcataacttattgttgtaccagaacacacctttcttctcaccttgcctgtccggttccacatagatacactccttcgcctccctccacatcgccttaaccaccggcgtcccatcgaactgataatactctcccagtatcggctttatcgccttcgtagcttccatcgcgtgataatgcggcatggtcgagaacaggtgatgcgccacgtgcgtgtccgtgatattgtggaagaccttgttcaagattccgtagtctctgtcaacggtggccaaagctcccctcaaccaatcccactcagacgagtcatagtgaggcagggaaggatgcgtgtgctgcaagtaagtgatcaaaactaagaacccgttgacaatcagaagaggaactccgtagaagcagaccatcgaggcaactccttggacagcagcgtagcggtagagaccgtagcagacggcgaggatgccagcgtcggagatgtatatctggagacgctcacggtcgttgtagatgggagcgttggggtggaaatggcaagcgaagccgccgtcgtaaggtctccccgagacgttgaaggctaagtacaaaggccagccgagagtgaactgaaccgttaacatcacggtgcgtcccaaagggttgttgaggtacttgccgtaccacttgatgtctgacttcttcttggggacaaacacttcgtctctctcgagggagccagtgttggaatggtggcgtcgatgactgtacttccaggagaagtaagggacgaggaggaaggagtggaagatgaggccgacggtgtcgtccagccactggtagtcgctgaaggcgtggtggccgcactcgtgggctatgacccagacgccggttaggacgcagccctggcaggcccagtagagaggccaggcgaagtaggagagagggtgagggaggagagggaagtaagtggtggcgacgtagtagaagcaggaggctatgatgatgtcccagatgaggtaggagaaagagcgagggatcgagcgtttgaaacagtgcggtgggattgctttcttgagttctccgacagtgaagggcggtgtctcgcagggtacgcgcttgatgttgtcggtttcagactttttggagggaggagacacttgcattcttccacctgcacccatgtttctgcataaaccaaaagcaaagactcaaagttaattaaaccaacaaattaatattcagtgttacgttattaaagtttcaaaaaaatggactaccacaaaaaaaatggatagtacgtgggataaagagcagagaagcggcatatagtggcaaaccaaagaaagaaataaacgatagcgttgagaatactactagttattaatgagatttgatacgttacagcttacatctctttcttgtggatatcaatttctttcgtcttttattactaaactacgttagagaagacaagtcataatcacaatgtctcttagaataagcaacttgacaaaaacataaacctaaatgaaacagttgatagcaactctattgtcaacatatagacttttaaacataaacaaacaaacaaaaatacaatctttttactatcatgaatcctattattttcttcatgcaaatctattgcatctgaatctatgaaggagcatctaatccaattaatttgcaagaaaaagtttataagcatgaagtgagcataggccaaatgaaactttttcatgtattaggtaactacagaatccagagccaataggaatcggtcaaatctctcagcaaattttacccagagacataagtttttacccaaagattcaacaaatatgtacttacatgtctcaggtccagatctaaaacaaaagtaaacaaatatatataactttgaataggaaggatatttctaagaccaggacgtgagactgctatggtgatttttcaactccaccaacccatcaaaaatatatatataattttaaaaacgattgaaagtcaaacagtttgtattcggacaaatgaaaatgcaacatttcatattctccacggtatagacaatataatcagattaatggttaagacagcatcaagatttcacacatgaaaacagagaatcaagaccagatctatagtttaatgcaataaatattaacagatctagaaataaatcgactgaaatgcaaaaatgatagatagaacagaaaagcgataagaaaagaacagaccaagattgaaaacaacgtaaaaatgagaagaaatggaagaagaaagggaccttgagctggctgacgtagggggggatgaagatttaacgttaataacgatgaaccctacgaagaagctcctcctcaaactctctctctgtctcctctctttctctctctctctatctctttggtaatgaatctctctggttctggtaagatgcgattgggcagaaggcaggccgtttaaattgacgggggcccgtgtgagacgattgagtgacatctcttttctttctttttttacaagtgggcccctccattatttcctctcttcatatttcttttttttttattatttttctactccaaatatctgatatttacaccacttatatatatttacggaaaagtgaaaaagatgccgtgatcatataattgcttttataaagtttatcacgtttctttttgtattttgtttttaaaatgtaaatattggtttacccaatcctaatgttcacaaagactagtttgggttatgttatagaactcatccgttacgttaattagcattaagattatggtatttgatgtctttactttaatatgaggaaacgtccttgccgactcacaagtagaactgtagaagttagtggtagccggaaagaaaagaaaaaaatgctataaagttgaggatggaggatcgtgcttggcttcttcttctcccatgtgagaagaaaacttaaaaaaatatctgcagacattgtggttgagatcacgtgaatagccccgagtgtgtgtgatgtactttggagattcgtcatatattataataaattaatttaggtggtacacaagtaggcagcgactgccgactagtaattaatttaagtactttattaaagctatcgctctctcttatgttaagatgattagagtttttctatgcattaccgcttataacgacacacattatttttaacattctttaaagatcatcacctaccatgatttcatttcatttattcagctgttactatcagcgacggctattaataacatgaatttttcgttatatagtctatcaaacattataagagaactataacatcgacaacgattagttatacagtctagcatactcacaaaataatctaagctgataatcacacacacatcagagaaacacatgaacttgctgaccaaaataaagcagagaaaacatgaagtattaagtagagacagcacacaaatcctatccactgttttgccaatcattcatcaagcctgccccatctcaaattcaaactagattctaaaaaaacaccaaatggggaaaacttacactgacaatgaaaactaaacattgtagtttcaaaaaacaaagacaactaaaaacaagtaggagaagatgatattaggaatcaccacaacaaatgaaagagacttgtttcaccagtaactctaggagcaattcatgacctgcgtagctctgcttccccgtgagcaaagtgacatctatcaccaaatgtacagcttcctttagagaatctctcacacatcttcgtcttgaagttgcttcctggatgtggtttcccttcagaaccaagcccacccccgccaccaccgccaccaggtggtctcctagatgcggaattaagcctcccaatcagctctctaaccattgcgctcgcttcgtttatctgctcgaatgttccttcaagctcaatgttcttcaggttgggatctctctcgtgatcttggatcgatagctttgctcctgtctgacgacatatctgtttcgaacagactccaccttttccaatgattgcgccggccaaggaagcatccacactgatcttggctgtggctgaggcaccaaagctagagacatggccaggccctgactctcctctccccgaaaaccgacctccaccaccaccaccaccagatccttgcatgtttctggaaacttgagacatgggtgatcccatgtttgtcatctgtgccataggattgtatcctccgggaacaaagtgcaagaaatggcagttctcaccaaaaggacagccagaagtgctgcaacagacgcataataaatatgtcaagagagttaaaaaccattggcattgagaagacacaagagaacaaacagttgaaacacagaagaaatggcacatagcaactatgctaactgcttgtctatgacggacatgttcaccagtattcagtaatgcaacaaccttactagacactatatgaccatgatgagacaaccccaaaataactaatatcttaccaccaaacagagaattacaacacatatctttactgccacagctcaaacaaaaggtgtggattgattttctacgctataatcaccagttgaggctaatatatttctaaatttataatcgaatatcatatttgttatattgaaacttttttttaactggttcagcatgaataataatacatacctgtaataagagctaatcacttacattagcatacattttttagttgtcaatttgaagctcagactataaataacaattttgaatattaatttagttaagaaaaaggattataacctgaaaaattttgtgcatggcttcgatttgcttcctaaaccagattccatctctgttccaaagattaagtgtttttctttagttaagactttgctgatgttcaataataattgcttttagaatcatacatatcattcataaattctcatctatatggaacttcacacttaaatcaaagctgctactctagaattttcaggattatttaccaacaactaccacatgaataactaacacataaaaaagctaattcaatcacagcaaactcaagctttgggcatggtgataatatgttacaagagggactaaactaaagcaataattaaaactcaagataactataagcttgatttaactttaagatcacttatcaaaagctcatccatcattaaactgaaaaattaatggactttagatttgcatcagatcaaagactgcagcaatctctctacttagccagagaagtgagcacgaaagaaagatccaaacttgaatttactagagaatacgaagctcgaattgaagaaatcatcgctaccccaaatcaaattgacaacaaaggaactattcatccatcaattaagatctaaagtttcaacctttaacagagcaagtgaagcaaaacagaaactgtaacagctaaaacactctttcgagacaataaagtaagaggaagagcgaaagagctaaccttgcttcgacttcttgaatccgccgccattggagttgaatgagccagcttcaggccgtcccctcttacgagcatccatggctaaaggtgtacagatccgaattagaaaccctactgtgtgagtgtctagagagcgaatcggagaagacaaatcgaaatcggaattaaagggagaaggaacgagtagagagaagagaataataataagataaataaaacctttttaaccctaagggtggtgttgtcttgtcgtcgagggggtgagatgagattttcctttttttcctaactcttcccgatttttttttaattcgatttaaaccggagtggcgtaacaaataaacaaaaaggtaaaccggaatgtcctgaaaaaaggataaaagataaccggattcgcaagatgaggctgtttcgattcctttgatacggttaacatgtataatgacgttgattgttccttattcgacatcttacgacgtaagacgaaaaataaattgcgtaccggtctagtaagttcggattctattatgttttccataccgaggagacagacacacaaccaatgtttatcatttaccttaaggctgggcgtttttaacttaaaccggtgtccacaccttaaaccgaaccaaaataatgagtccggttcggtaacgggaccatgcaaataccgaatgggtttttagctctaagcacttcggacaccgggtcggtttggttaggtaccaaaccaaaaaattttaaaagaggaaaatcatcttacaaaattactgtatatttatgtagaaactaaattattttgttgaaaacgaagcggtgaaagtcagtataaatattatatatatatatatatatatatatatatcttacaagaaataataattgttctaagtaca

SEQ ID NO: 2 - DNA, 40174 bp, Brassica napus
gggggtggggtatagattttggagttttttataatttgggtagactttggaagttgtttaaacgattttggtgaagttttgaaaatacatttaaacaacaccattgttgcttctgagttatctctaacattatgaattctaatgatattatcacctcctaggatgcttacagtaaaagaaacaacagttttaatttttttcttactggtcttaataagcccattcagaaatatctcccaataatctcttcactgaaggtccctacaggcacacgagacactgctatatgcttctgcatatctttggcgaatatagagctcatcacataaaaacaaaaagatgatgaacctaaatcttcaaattgcaatgcgatctctcgcggaagaatcaaaaccttgaagttgctgtacttttcttttctgtatggttctctgagtgggactaagtattatttataatatttttttgtaattactactatttttattttttattttttttattttaaaaacataatataacttgataatattttgtttctttttataaaagatatcaaatttgaaataacacaatcctattggttggtgaacctaaagattcaaaataaacccaagaataagtcaataaagaacaacaatatttatttgatatatgttttcataaattatatgtagataaaatacaaagcacaacggtgcacaccagcatatgcaacgttaaagtttagattttaaaataataaaaaaccataatacatttttaaccgtagattttaagttacatagggccggcccgctgcggaagcaacgtaagcgacggcgtagggcacacaacgtgtttcaatttttttttacagctaaatttgttcactaacttttaaaaaaaaatcatccagctgattaaaatgcacattttaattttggattagggcatctaatagtaatggaactcgtacgatgaaactttgaattttgtgaaagaaaactccaataagttaatataatcatgttattggataatgtacataaattttaaaggtgactgtttatgaggaaacaaatcagatatgcacgattttgtttcctacaaatggctaattttaccaatttatatttaagttgtttagattgttttccttcgagtgtgtattaaaaatttattcaaaagtatgtggttcattgaatattgatatttacaatgaacacgtttcatacatagatgaaatatagatattaacctaaaataaccttaacaaaaattaaaatacaataactttcaaatcaatattcatattattagtatatataataatacttagtcccactcacatttacaatcggctttccaaaactttgtgctacattatgtttcatctttcaatggccaacactaaacaaaaaccagtttcaatcttattgcttactacattttgcttcttgtcgttatactttgtgaaaaatcaagccttctcaaaagtctcatatccatctaccttaggtctaaaccaagagaaactaacacatcttcacttttacttccacgacatgtatggttacaacccaacatcagtggaagtagcagaagccgcacaaacaaacacatctaaaacatattttggttccatgttcgtaatggattgtcctataactacacttcctaatataagctccaatataatagggtatgcacagggtatgacagcatctgcatctcaaaccgaattgggattgttgatgattctccattttgtgtttacggaaagagaatataatggaagcacgattagcattcttggacgtaaccttgtgtttgagaatgttagggagatgcctgttgttggaggcagtggcctgtttcgattcgctagaggatatgctgagggaaagacgtattcattagatgtgaaatctggaaatgcaactcttgaatataatgtatttatcttgcatccttgatgtattatacaataatgttaaagctaaactattttattatcgttgattccgctaatttttttgataattacagtgatgatatttcataatttataaatttgttttacgtaaattaatgtcactatgtcctaatttggagaacaatagtcacattgagaaaatgtagatcaacttttttactacagagttaaaccgcaatataagaactaccacatgtaatgtgagagactcaaagtttagaatccaaatgtttttcgattaatttgtttgttttgatatggatctttacaatacaatttcttaaacactaatcatttacaaaactggttgttaacttttcattttttgttggtccaagatgtgaccgagacacttcaaatctctacttatatatctctttaaatttttgtaatcaaccaagttttagctatctttgtaatacaattttcacttcatgaatattcgcattctcgtgaatcttgattggttgcaataaaataaaaacaaaatccttggcatcaactgccaaagtcgatgttagaaaataattttttttttttaaacgctagaattttatagaaggataacagaacaaaggttctacaaggatcatcttcaatcaaaagagacaaagagaggtagaaatattgacctaacaaaataggtaactaagccaacatggatatcctctagcaatataagattgaaaaaaatcctcctggatcacactttttgcaataagtgttgctcctttaatgttatgataagagtggaattgagtcttccaatccgggaattcattcagtaatggtaagacctttgaagagtagaaccttatagaaggccatgcagatggtttagagatggcgccaatcaggtcatgatcatcactagcaaagatgatggagctgaaatggagagtcttcaatatctcaataggccatctctagttttctagagaggcatcctgtttgcacgaagtgtcagagaaggatcttcttccatggaggagaattttaccttcgctgctacgaagaatcctagagtaaccttgagtcgtcagtaggtatcactgcttctttgtgtgttgattgatttttgtactcatcttcttcattcattgttctggaggtttaacttcgactttgtgatggcatctagaaaaggatcaaagctgaggaaagcagggtataccaatttaaagggtgctgattctactgcttcctcagcgacctcgtcttcaaagctttatcaggagacatctattgatgatggccatagctcccctgcttcttcatctgctcaaagcaagcagcagttcttctcatcagattcgtttccacaaagctctaagccttctaaagaaaacgtcacagtgacagttcgctttcgcccactcaggttcagagtgaaatacttgtatatgcttgcaaatataaggttgatgtttgttctgtgaatttgacatatattttttccttgacgtagtccaagggaaatccgcaatggggaggaggttgcatggtatgcagatggggaaacaatcgtaagaaatgagaataatccgacaatagcttatgcctatggttagtctttaacaatttaattagtgtcatggtgaacacatcactcaaaaacaacaaaactaaggacaaatagtattgttcttatgtgatattcattttcacttgtaatcatgtcttaaaataggaggactaagattaaattggatattcttttttttttgatattttgatttcccatgttgttttcttgaagttgtctttcaatctgttaatgattgattctctttctggcagatcgtgtctttggacctacgaccacaacacgcaatgtctacgatgttgctgcacaccaagttgttaatggagctatggaggggattaacggtatgaagtgaccagttttaatgataagtctattttaaaatagaagaaacgaagagcagcgacacttgccggcggcaattctgtaacaacactccactgtaattcctctctcatgcttgttattttttggtcgctgttctctgacgcgcgttagagaaacgaacagggcttttgtatttttttttgtcacagattatttgttgaaagactgttcttagtgtgttattcttcagaacagttgatttgaatataatgacatcaatgttaatccactacagggaccatttttgcatatggagtgacaagcagtggaaagactcacacgatgcatgtaagattccctaataccgtttgatttcaacacaccctactgttgaaaacttgaaaccatgtttgcatttaactttagaatgtccatgacttacgattaatattatctgatagttttggttaattttttggttcaaatgtcagggtgaccaaagatctcctggtattataccgttagcagtgaaagatgctttcagcattatccaagaggtacttttgtaggatattggttcgtccagattccttggcttaagtactagcagcctgacatattaatcttttacagacaccaaatcgagagtttctcctgcgtatctcctacttggaactttataatgaggtgctattatttacctattgtcttgtctgctttatattcattttcaatagtagcagagagtgatagaaataattttcctttgagattactatctttaaggtccaccttatttcaggttgtcaatgatttattgaatccagaaggacacaatttgaggatcagagaagacaaacaggtatgtgactcactttcagatcaccttttgatacatgcaactacttctcttgttgactcgtaatatatttgttgtgtttacgagtaatatattttgcttatcatagaatcttttattgggaaccatggttaggctatttggtacctgaaaatatatattggttccattatgaggactctgctattagaatgctttcatatgtggccctttgtttcattgcaatgctctatgtcacaatgttttcaagcacatttgaagttgatcctcctaattatcatttgaaatgagaattgtataatgagcttctcatggcttttattcaattttttttaattgaacccatttttgttgattccagggaacttttgtagaagggataaaataacttcctctttaagatatttcgtccttcaactctgtcatgatttggtaaatttccatattattcaatgcatgcttagtaaatctttttcctcatgacagagcaacgccatgttggatcaacaaactttaatttgctcagcagccggagtcatacaatattaacgttggtatgttaataatctctttgaagcaagggagaaattgctatctgtgtgcagttgatatatcatttttttctcctgacaagattaaaagtgaagctgtacacctctcacagctggtaagctactcttataaccagtgatatagttagttatgattagctctttcgtctacgctaaagcgaattcaaataatattaactacccataatttctctcatatttgcagaacctcgttgatctggcaggttccgagagttcaaaggttgaaactagtggcttaagacgcaaggaaggatcatatataaataaaagtttgctgactttagaaactgtgagtttttttcttaccacacagttttctcttagtcaacaataggttttggagtcaattcagatagtacttttgtgatgttgtaggtgatacaaagctcagggatgtgaaggcttcgcatgtaccatacagagactctaagctaactaggatccttcactcctcactgagtggtcatggccgagtatctgtaagtccttttagatctgttctcaatcccctttcttatgaaatccacaacatgattaaaaacatcttgataaccttaagcacatactttgctagttatgtactttactgattagttgtccctttgtggatatggtagctcatttgtacagtaactcctgcatcaagaagttcggaagaaacacacaacacattgaaatttggtcatcgtgcaaagcatattgagattcagcccgaacaaaacaaggttttactcgcatatcttctacctgcctttatttttttggtactaacactacaaaactgcagataactgatgagaaatcactaatcaagaagtaccaacatgagattcggcgactgagggaggagttggaacagcttaaacaggacattgtaccagttcctccactgaaggatatgggtgcacatgatactattctcctgaaccagaaggtatgctcgaaagataccttccatccccatttatacttttgtagtgattaagggatgttttttttctgaatagagttccaattttgaaaacttaaaatcttgtttttaattgtcattcatgcattttcctgtcagtgataaaagtttaatatgaactgataatagttgaaacccacttatacgttggattagacaagtaggaggacattttgtgtcattgtgttttagttacaatcacgcatttgagagaatctgtagtaattttgttgtttcctttttttggctatataacgtgataatagaagctagaagatggtcaagccaagctataatcaagactagaggaagaggaagaagctagagcagctctctcgagccgaatccaacagttgacgaaactaatattggtgtctactaaaacttcactgacatatcgcttacctcatcgctttaatcctcggagaaaacactcatttgaggaagaagaggtagaatcactgatatagcttgaatagtataaattgtttacacgttcctgtggagggaagtcctgagattagagatgttccatgtagagaagaaaagaagagccggaagcatgggttgttaaattggctaaagcctaaggtatacaaatgtctgactttttgtttaaagaataatgctataagtaatagtagaaatcaccacacagccttgtctcctcttaggtgcagtttcttcttttaattattctctggtcaactcccctttgttgatccgagcttacttttacctatcagaaaagggataacagttcaagtgctagcgaccagtcgagtgtggtaaaatccaacagcacgccatcgactcctcaagggggaggaagttatctttacacagaatcaagactttcagaaggatggcctttgatggaaggaacaactctcagagtctagagaagacagagaagctcctgaagacatggagactctggaggtacataagagatactttcacatctgtaatggcgccaaagtaactaaatcattcatatgtgctcttgttcccagactagcaataaaatcatcgatgagttggatcttatgagagtgcagaaaaagattttatctgagggggtggcgcttcaatcaagttcattgaaaaggttgtcagatgaagctgtgctttaaatctaccaaatattcaccttcttggttctctaatgttacttaggaggagattaatgccctacatgatggcatcaaggcaaagagtgaccagattgccaccttggagaaattaacaaatcttggattatgttatgacaacacatgaggcattggataaatctgacatcctgaaggtaggttgttgacattgcaaagtattatgcagtgagttctttttccgttgctcatttcacaagcggtgctctattatcttcaggcagttgctgagctgagggatcaacttaatgagaaatcttttgaattcgaggtgatcgaattgtttatgtgtttacatacaatacttcttcatctattgatccagcacctagagctagctttgctattgattagataatatatgttcacaccttagtaaagttgtttctctgcaaatattagtggtcaaatgccagactatttaacgaagaagccaaatcatatgctctacgtttcgactcatcattacatcttgtttacaggttaaaagctgcagaaaatcgcatcattcggggaaaactcaatcaaaaggtcagaggctttgtctttggagaagcttgtaaactaggtttgtaatgtgtagtggaattgaataactgatgaattattttccgcagacatgtgaacgtgaagtattgcaagaagaagttagaaacctaaagcagcagctctctaattcccgcaaactagcacaggtctatctacatacattttattcacgccttacaccaatcttctagcttaatagcttcatgactctcaacataaaatctctctactttctgttatgaaaggaaacaaagatcgaagagctgaaatggaaaacttaaggaactaaacgaatctaaggagcaactagaacaccgtaacaagaaactcgcggaagagagctcatattcaaaacgccttgcatcagcagccgcagttgagctcagctcaaggcattagccgaagaagttgcaaaactaatgaatcaaaacgagagactatcagctgagctagcaacacagaagaactcagtcacacagcgaagcaacaagacaggaacaacaacaacaaatgtaaggaacggacgaagagagagtcttgcaaagagaaatgaacaagacaactcgtgggagctaaagaaagaactaagaatgagcaaagagcgtgaactatcatacgaagccgcactcgttgataaagatcaaagagaagctgagcttgaaagaatcgtaaaagactcaaaacatagagaacgagctcgctagcatgtggattcttgtttcctgtgttttaaaaggcgatcgccttttgcgccaaggcgcaaggcgcaccggggcgatggccctaatgcctcagtcctctaaggcgagccctagttactcaaggcgctcgccatggtgcgccattggcttaaatataagcgcctttgaacctcttaaggcgcttgtagtttccgttaaacactactttgacggaatccttaaaacatcttggaactctatcactactttgtcgaccatttaaatatcctaaaaacataatgcttagatcttcagagttataggttttgttggatttgagcaattgaatttagctttttagtttcaagttctttgttttgatttgatgttttcgggtttatatatgtgtacatagctgactatattagtgtgcatgactaactcgttgctgactatattagtgtgtataaataagacagtttggtatagctgactgtactagtgttatatacgagtctactctataacttatcttctgtacgtaaccatagaaatagttacacgtctgtagcttacacatacacttctaacctaagaacatctatcaatgcatatctaagttcctctaaagctgtatataactaaaccacgtttgaatgcatcctaaccataaggcgagcgccttggagcgccatggcgcaaggcgcatggctccaacctcctcgccttagagcgccatgcgccatttaaaacacagcttgtttctaagctgagaagatcacaaagaagctgattctgttaccatatcagagacaccgccacaaaaacttaacaaagacgaatccaaacaaatacataatcatcacaactttaaattgtttcttattccgaagaattaaaaataaaacaaaaggatagaacaatgatcaatactaacggatcagtcagttagtcttgggatcaggcatggggaacaaaccagcaccagcagcgccacgtggcggagaaaaccctagaaacttctgcagattcgtccttatactaatcgaacacagcaaatacaaaaacgccatggaacaatccgtggcatcatctcccttcaaccccctgtgactcatcttcttcacgatcgcgatcggatggaacgggagcttcgcgacgaccttaccttcgaagagcgagttcaacagcccgaagacgacgaagaggacgagggccacgacggcgccggatttgaacttgaagagggacagatctcggctcgactccttgaggctcgtctcgacgcggtccatcttcttggtcttcgatttcttgacggtgagcttggaggaagggttctcggtcttcatcgtctccagcttcttggcggctttgtcgattgagtattttagggatttgtaggaggtggtgcggtagattaggatccacgagatggcttcgcagactagcgccgtgcagaaggagatgccgacgacggttaggctgtcggcgtacttgaaggaggcgaagagtgggatcgtcgtcgccattgggatttagtttcttctgctttcgcttctgttctctctctctcactgtggagatctgattaggaattgggtaaaataaaagtcaatagagggtacaataagtaaataaggaaaagtttgggggacttttagaaatactttttaattttacttgtaaccaatacctttcgaattattagaatttaccccagctgttttttttattccttgctatgcaaaacccaaattacaatttttaacattagcataaacactgtggtgcacatcaaatagtgtaaacttgtaatcatgcagatgtatgtttttactcacagaaaagaagaagcaagggaaaaaaagattggtaagtttgtaccaaactcattagttgtatgggttttatgtactagattattttttctaggtttgatttgaatcagagtttatttgggttttgattagaaaaatgtggagtaaaagagagtaaataataaagtggaaaatggagaaaactttggaaattgaaatgaaaagagaacaaaaaattagaataaaactcgtttcacttataaatcccaaaataaatatgtgagtgtttttttttaatttcatccctcaacttaatgatgctacatagttaacatcacgaatttattttcattcatctaaaaattgatgtagattttagaaaccgtttaaatcttatgtttttattaattaaaatatgatgtacatggcggtaatttaactaaatatgaaagttacataagatattatttaattttggttttcaattattttaatatgttttcttattaactcttaataaaatttttgtaatttatttgattaattgtgtggaatatacttatttgatcattttttttattataaaacttatttcatgtcaaattactgactctaacattttatttgtttgatataaaattaaataactaatgaattattttatttatatattcataaaaaaaaattgcatacattttaaaatgtatcaaataagtatatatcagacaattaatcaaatgaattacatattttttattaaaatttcataagaaaatggattaaaataatttaaaaacaaaattacataatatcttatagaattttcatatttaatataaataaaaataatataataatatattttcatatacacaaaaataaaaatgttaaaacactacttataaaaaaatgttaaaacatattgattttgtaaaatcaattatgttaaaaatattcttacacttttaaaatgtgggtcaaaatctcatttagttaaattacggccgggtcggtcatattttaattgatgaaacgagatatttaaacggtttctaacatttacatcaatttttggatgaacgaaattaaacttatgatgttaatgagatatgttatcatgcataatatataattcgcgtagctaggtatacattagtttagtttgcatggttaaccatgtgaatgactaatacttcaggtagttagcaaatatttttttccttcttttaatcaatgaacctaaatccggattgaaatcctgataattgaattcaacccaatagaacaatagtgttatcatagttacaactaaaaaaaaacttaacagacaaatctaaaatttagaaatggaaatatgagaaggaatggaaaaacttaacagacaaagcgtttcaagaagaaaaaaaaattctagaggcttcgttttgcgttagttcattataatgcaagtagagcgaattcgatgatttatttattttgaagtaccatctcattagatggtatttgtttctagtggattttgtatgtaaaatcaactaggtgattatccactcacatgtgtggagtaaaatgtatatattctaataattgttgaatatgaactttgtccgtataaccataattatattattcataagcctatatatgtattaatttgaatatctattaaatgttagtttactcgtatggtttttatgatcatttatattttattataataaaaaatttaaactatagatcataaaattttcagtgtgagagttttaacaattttcattatttatagtcgtttttaaacattcaaaatataatatatacgaaaaatctattttttattatatggttaatatgattgtttaatttattttaatactataacattaaaaaataatgaagatatgtgaattgttgtcaagtctttattattaaaattattaattgtcaaatatatattttagtcacgtttggtaattccgtaaattttatttaagaaaaaaaaacaataattatatattgttaattaatttcatggttattctaagtagaagtatataatacatgtttaatagaccaaaatatttctttagagactttaagaaacattatagtgatgacacgtgttatagttaaaatgttgtaatgcttatcttttaatatatagaagattatctaataatttccaataactcttgataaatactaggaaaagaacccgtgcgatatcgcacggtaactcattttgtaaaaaatacaatacaaataaaattacaataatttttgaagataatttttttaaattctttataagagtgtatatatatatatatgaaaataaatgaaaagccaatttcatatattttgataaaaaatttaaaaacaaaggcaatttcatgtagtgatctttgatgatctaaataatgaatctctttcttttttagtttatttgtgattgttgtgattttctaattttatttggtgtttattgtggttgttatttgtcattttcgacaactatttatatatatgactaaggattgcaatagttgacaatcaacctttgcaaaggtttaactaagggttacactggttaacaccaaaagttgcaacagttcacaactaaaaacaataatcactaataattgtaatttttttatcatcaaagaatgtaatggttcaacactaacagttgcatcatctaaccaattgtaactattcactaagacaacatactccacttaaacagtctcaaagattcacttaaatctctaacaattatttcttatttaattattatcagagattcacaaaataaatatcactcgtatcaaactcatgcacgaataaaaatgtacgtaacatcaattcgaaaaacatcataaatgtctatttatttgatagataacaaaatggatcatatatttttataaaaaaataggatcatatatgcgttgtacgtatataatttgacatatcattaaaccttgtatcagatgtgatgtcaaagttactaatatggtagatagattattctttgaaaaagtatttgtaaaatgggatgaccgatgattaatagtagcttaacagatctctcttcacaaaaataaataaattaatagactatttagaagaaataaaatatcagatgtaaaagttggaatcttcgatgtataaatgttttcaaagaggtgtctttggaagaggtttaagccgttttgatttgaaggaatgcattgattcgagaaaggcaaaagcgttctttggtttaataaatgatgatgtcatctatttaaaggaaatctaatttttaaccattagattattataaaataaagcaaatctaacagttagatatatctttttttcctataaaaaatgatgatattatcagttaacaaaaaaacaggtttcctattatgtatagaaaatttaaaaaagaagtaagaaaaacttgctttgatagtagcaaatgtcattttatttgcataacttcttgtatatctgccaagaagaagcaaggttggtttcaaggtgactctttaataaaaacaaataaacacgaaccaaaaacaaaaaatcagtttaatacccagcgagttgattattgatcatccatggtctccagttatcaataaccgaatagttgagagatcttatccaagcttgagtcccaatgtaaggtactgtcatatcgtgatcaccaatgttcacacaaaaccacacaaatatttacataaagattttgaatcttggtgggagaaaaaaactctgacctgaagatgagagaacgatagccattgatgctattatccatatggtaaggtacattacttataatgtcgttactgtaaggaatatccaaattacatcgtatccatctccctatgctctactacaattatagatcttcttaaaaaacttgacagcgcttctttactaaactctttgaaatgaacagtcttatataccttcttgatttgaagagctttgcgtacgctttcgctttcgtcatttgcccagtaggtagctagcaaatacctataaatctgcaaaagcaaccttatatatgctttgtttcctgaatggtttaacggtaaagaaagaaggttaaaaatttataacagtagttattttaaaattatacttataataatagtcacaacttttcactttttaaaagatatctatacataatagcaaactccacattctgtgtttgatgacatcaacattttttatagcaaaataaaattgaaatcggacggttgagattattgcggttatgtaatctagtggatattatttaagtttcatttagtatatgatgtcatccgttattatatctaaacgatgtctttttctttttgaaacgttgcatttttgaaacattgcttctgaagagacacgaccctctcaaaataataattcttatatctaacggtgtcttgtttttgaaacgttgcatttttgaaacgttgcatttttgaaaagatacgaccctctcaaaataatagttcttaaatcttaacaaatttatatattcattctttatgacttccctacttcccgtcatcattgttcttttttctccttcacttaccatggatttcttttgttctggaaataaccgtctctctctaagaattttcatgtctgttttcaccaccaccgccatcctcttttctgtttgttatgttaatctccatcctcattttctgtctccccaacccactactatattaatttactcataaccgttgaaatattagaacatgtgttgtcctcatgaaaccatttgatgatattttaaccgggagattcaagagactgaaatttataaaagggaaatatgatttcatgtttcaagaaggaactgacaatcataatcaatttaacttacaaattagcgagaaaagctttagcgagagaattccgatgattctccctccactgtttccaggccttatgagaatataatccatcctaggaaaattaattgtaccaaaaatttaacaaaaaaattcaccgagcatctttccacaaatcctgtatatctgaagaaaataataattgtgttgaattctttataattgtgttttttcacaattctttttgcaccatcaaatcatcatatatcactctcactaatacgcatctcttcgctctcaactggctattttcagccaattgttaaacaatttttttgatttccggctgacattgatcctagcactggttgttttctctttttatttacttttgtttttaatacatttagatctcggtttactaccattaaaatcagtggaagagacttataattgaaaaatgcatggcggagactatttatagatttttaaaatctatttgaatagtcacatcccttcaatctgaatagttgcattcttctaatactcacaacttttcactttttaaaaaatacttatgaatagtcacaacttttaaacaatttttagaaaagacacaaccttacaacatagaacttttagaaaagacacaaccctttacacatctttttcaaaagatacaacctttcaatataagtgagattcacaacctttggaattaatgaggattgctattattagtagattatgagtgaaatctttgttttccagtaaggagagattcgaaagagttttaataaatgattaattcaataagagtggatttgatagaacttttataaatactaagaggagatttgaacaaaaactagaattctcttaaatcataagccccctttgttcctatctgttttttggtcaccattccattccagaaaatgcttttaaagataacaatcacaacattccaaatgtagaaaaggcacaatctcaacattctaaacctgcgtccacctaacaaaaaacaattgccttctcgtagtttactccaaatacaaagggtgtaatataacaacagaaacactcaacactttaccgaacacacacgttgccttctctcctaactccttaaagttcaatcttcataatctctctctgtctctctctctctctctctctctctctgacaacagagagactcttcacgtgccaacaaaaaaaaactgagcaccttcctctcgcccatggccacggactccgtcaagcacgtgcctacattcggcggcgcagccatctctgaaatgaaaagcttcttctccgccatgaaaccaagaaaaacgatcataacttttgtctacgccttcgtcataacctttgttgccttcactgtttacttagccttcgccccttccctcatcactatctctaattcagtttcttcctatatcctccctaatgtcagtgccgtgacttcagcgtccagtaacatcacattacaagcaaccacgccggaaagtctcactccggctgttataaacacaacctttgagcctcccctaggtaatgaaacaaacccacattctagaaacaacgcttcacggtctcatgcaagtgtacacttatgtcctaacaacaacactgctcgaaattcggacaaacaagcacctctgtccgtgaattcaagtgcttcttctccgatgagaaaacaaagtaggaagtcaggggctaaacgagagatcaagtctctgaaggactgcgattttttccaaggagaatgggtcaaagacgaatcctacccgctttacaaacccggcacgtgtaatctcatcgacgaacagtttagctgtttaaccaacggaagaccagacgttgagttttacaaactgaagtggaaacctaaagaatgcactttaccaaggctgaacggaggcaagttgctggagatgattagaggaagaaggctcgtgttcgttggagactcgctgaatagaaacatgtgggagtctttggtttgtattcttaaaggatcagttaaagatgagagacaagtctttgaagctcatggaaggcatcagtttcgtcgggaagctgagtacactttggtcttcaaagtaagtttgcaatctgtttcggtgaggcctgcgggtttggctagtttgggctgggtcgttcggttcgaccaaaatatcgcccaactgaaccgaacagagtttggttcggtttaggtagttcggtttttcaacttcttttaccgaaactaatcaaagtttttggtttcaattatatgttggtttaaaatttctttaaattcggggtaatttggttaattcggtttgtcggttattttgattcgaatttttgattagtttagttagcttttttttggaaaacccgagctaaccaattactgaagtgaaaaccgaagtattttataagcttgccgaattgaaccaaactaaccaaaaattttcgttcggttcggttatcaacgaggcctagtttgactacctagttgttattggagacttgatttgtgtggttgatatgataggaatataattgcactgtggagttctttgcgtctcctttcttggttcgagaatgggaagttacggacaagaacgggacgaagaaggaaactttgcgtctagatatgatgggaagctcatcaaagcagtacataggagcggatgtacttgtgttcaataccggagcttggtggactgatgacataacatccaaagggtagagttctgtcagctattttttatttttttatatggaggatttgtctcattggctttttggtgtttggatggttttgattagtgaggactattttcaagaaagaagcactgtttacccgaaactcaacgttgatgaagcttttagaaaagcattgactacttggggtcgatgggttgataagtatgtgaatccaaagaagtctcttgtcttcttccgcggattctccctgtcacatttcaggtatgtacagttctttcatggtagtcttaagattctgtttaaaaaaataaataaatgggtttggtctggttgcatgcagtggtgggcgatggaatgcgggaggggcgtgcgatgatgaaacagaaccgatcaagaacgaggcatacctaatgccttacccttccaagatggagattcttgaaagagttctaaggggaatgaagacaccggtcacgtatctcaacatcacgaggttaacagattacaggaaggatgctcacccgtctgtttataggaaacagaaatttactgcagaagaaagcaaatcaccgttgttgtaccaagactgcagtcactggtgcctcccaggtgtacctgattcttggaacgagattctctatgccgagatgctggtaaagctcgaccagctccgtggcaacagacggcggaaacctgaagggctactataggaggagttgaatcatattcttgttttagatgaaatacacaatatatattttcaatggatgaaaagaaaagaaacacttagaagcaattatatgttttcaaaggcatagagaaagtaagagatgagaatcatattactgccttgctcatcacttttcttggttgtaaactatgttcatgggagaggtttgagattgtaaatggttaatttttattttactcaatttaatagtaaggtttgtcaaatcataactgaaccggaaatggaagcaatcatttggttaaaagaatccggttgatgacatcgactggcaaagcataggcaggatcaatttggtttgactccaggatactccagccctgcaccagttttggatcattaagttctctttagctttgaagaccttaacagtatgtactaatgagacgcaaattttagtcacctgcaactccaaagtaagtgtgaaagatatcaacagcatcgtcaggtccattctccatatcttattcaaattacacctgaaactcagggaaggctctaaagagatgtgagttttatcaaccaatgtttgagaaaaacctgacagtccaagatgaactttacaagctttgatttgtcaatccaatggactctgttggtcatgataaaactcgataaaacccaccaagagtggcaaacctggtgataattaagcaagaacaatcagtgtggtaagtgttaggataatgacgtatcattatagagataatcatagtttaagataactgttgtatttatcttatagataactatgagcatgtgataagatcaacttgactctatcacatgatctcgacttgtataaatagagagctgcagacatcaataaacttaagctttccacaatacaaatcttatatggtatcagagcaattctcgatccaaatcgtttaaatttttcttttctcttcacgcaaacacaaacatcgttaacatgtctgatcaaaacagctctctcacaactgccactgctacacgcaccgcagtctatgatcccgcaaaccctgcaaactcgcttcttgcggttaacatgtcgaacgttacacgtttgacaaacaccaattacctcatgtggagcagaaaaattcaagccctccttgaaggtcatgaactccacacttttcttgagaaaacagaatccactccagaggcggtcctcatcaacaatggcctcgcagaacctaacccggcgtatctaccgtggagacgtcaggacaggctcctatacagtgccatcattggtgctatatcccttccagttcaaccactcgttgcaagtgctacaaccactcatgaagtctggagcacacccaatctcatctttggcacaccaactcgcggacacatcaaacaattgaagttccaagtcaagagctgcaccaaaggaacaaaaaccatcagtgagtatctgcgtcttatcaagaccaaagcagatgaactagcactccttggcaagcccattgaccctgaagatctgatagagcagattctagcgggtctctctgaggaatacaaagccgaagttgatgcaatcaacggccgagatcatctgatctccttctctgaacttacagagaaacttcttaaccgagaagccatgattgtctgcgatcaaccagcaacaccgacgtttccagttacagctaacaacaccacaagaagcaacaccaacaacaataaccgcaataacaacaacaactggcgtccatcctttgtcccacgacaaggcaacaactcgcctcgcccatctcgtccctaccttggaagatgtcaggcctgcggaattcaaggacatagcgcccaacggtgtccatcattcaaagtcattgcaaccaactcaatgcagcaaaacacccaacacgctcagtggcgaccacatgccaatgcaacgtacatgacaaaccaacaccctgatgcttggcttatggacagtgcagcctctcaccatgtcacgagtgatctcaacaacatggctgcacacatgccatatgcaggaccagatggcatagtgattgggaatggagccaatcttcccatcacacacaccggttcactttctcttccaacttcatctaaaagtttcaatcttaatgatgttctttatgctccatctatgcaaaagaatttgatctctgttaaccggttctgtaaaactaacaatgcctctgtggaattctttccaactatgtttcaggtgaaggatcttccaacggggacaccggtgctgaccgcgccagttaatggcaacctctatgaatggcctaccaatgactcacgcactcctcttgctttctctgctgtatcatcatcgtccttagactggcatcacagactaggacatccggcttttccgattttacagcatatttcttcttgtttttctcctggtttttcttgtcgttctccaaactctcttcattgcaatgcttgttctattaataagagtcacaaattgccattccataaaacatctattacttcctctcgtccgttacaaattcttttctcagatgtttggtcctctcccatcttttcttttgatggttacaaatactatttactcatagttgaccactatacaagatatatgtggttctttcctttgaaactaaagtcacaggtcgcagccacattcaccagatttaaggagctcgtcgaaacacagttccaaacaaagatcacaacactctatagcgacactggcggtgaatacattgcactccgaccattccttgcgcagcacggcatctctcacctcacaacaccaccacacacacctgaacacaatggcctatccgagagacgacatcgacacattgtagagacaggtctttcgcttctcactcacgcttccatccctactgaatattggacatatgcctttgctgcagctgtatacctgatcaataggatgccaacgaaagtactttcaatggacaccccttacaatcggctctttggaactgctcccaactactccaaactgaagatctttgggtgtctctgctacccgtggctgcgaccgtacacatccaataagttggaaccacgctccactccatgtgtctttcttggttattctcttactcaaagtgcttatttctgttttgatccctccacttctcgagtctttgtctcacgacatgtaacttttgttgaacataagttttcctttgtttctttaagtgccaatgtctcttccactccagcaacagaggagctagcgtgggttcctacggtggaacctttaggtcagcaacaggtactcgtggaggagccctcaccggaaactggacctgcaccaacaacggcatctccaacaccaacagcacctgcttcaccaacagcacctgcttcaccaacagcgcttgctcagtccacagctgcccctcctgctacaagctctcagccaacacaacatgccatgacaacacgatcacgcaacaacattgtcaaacccaacccaaagtatggcttgacaacagcacttgccccgtacgttgagccacatacaatcacacaagctctggctgatgagcgctggcggaagtctgcaactgcagagttcaatgctcaggttgtcaacaacacatgggatctagttccagctgaagaagcgacaaacctagttggcaacaggtggatcttccggtacaaatacaaccctgatgggactgagaaatcactgaaatccagactggtagcaaagggatatcatcaacgtccaggaatagattatcatgaaacattcagtccagttatcaagtctccaacaatccgacttctacttgggctcgcagcaaaatatgactggcctcttaagcaactagacatcaacaatgccttcctccaagggactctcaatgaagatgtctacatggtccaaccagcaggcttcatcgacaaggacaaaccaaatcatgtgtgcaaactcaacaaagccctctatggcttgaaacaggcgccacgtgcttggtacacggagttaaaaacatatcttctcagccttggattcaaaaattctgttgcagatgcatctctgttctttttacatgatcgagggatcgtcatcttcatgctaatttatgtcgatgacattgtggttactggtaactctctttctcggatccgtgacatcatcaacaacttgtctaggcgattctctcttaaagacctcgatgacttgggatacttcttaggcattgaggtcatgcgctcgtctcagggtattgatctctctcagagaaagtacattgctgacctacttcatcggaccaacatgacacacgccaagccagtaccaactcccatgtgcgcctccacgtcgctctctatacgagatggtactaccttggataatccttcagagtacagaaatgttgtcggcagcctacaatatcttcttctcacgcgacctgatattgcacttgctgtcaacaaactctcacaattcatgcacaagccctcagatactcattggatggcggctaagagagtgctacgttacttggctggcacgtatacctctggcatcttcctctctcgtcagtgttctctctccctccatgcctattctgatgcggattgggctggcaacaaggatgattatacctccactggtgcgtatgtcgtcttctttggtcaacaccctatatcatggtctgctaagaaacaaacgggaatagcacgatcgtcaactgaggctgaatatcgagctgtctcagctgctgctgctgaggtacgttggctctactcgttactgcgagaactacacattccaatcatctccaccccgacgatctactgcgacaacgttggagctacctaccttagtgccaaccctgtgtttcattcacgcatgaaacatctagcacttgactttcatttcatacgtgaacaagtgcagaatggagacacgtctcatcaaaggatcagcttgctgatggtttaaccaaaccgctaccaaggaaccggtttcaactcctctttaccaagatcggcctcaataaccgtgctccgtcttgaggggggatgttaggataatgacgtatcattatagagataatcatagtttaagataactgttgtgttttcactctctaactccagttcgccctagctggttctctctcaggcacggagtccaaggcagccgcacagcttgcatctccgccagaatgaaggtctctttccggtgcagctcctcctgtcctaatcacgagcctctcttccgctgctgatgacgtttcgctcaccatcccgaagctctccctcttctcctccaatgggttcctctgcaactgtcccgtttggttctcctcccctgccgcctgaaccaccagatccggatcttgtcgtggtgtttccgataaatcctccagaccctccaccggtcctgctggtttgtccctttctccgccagttctcgccgtcttacaccgctcctctcaatcaaaaggaaatcgaatctcttatgccatgggatctctgcttttcaaccggttgcttgctcaagcctctctgcccagacgtcgatgtgctatccacgcagcctgctctgctgcatctttcgttggctggaatttctccctccggagctctcaactctggcctgagttactcctcctttcgacattatcccgtttcaaagccgataattattacctcttgtgtggaacatgttttgttaaagtcagccttaagggcatcaacgatttatcatcaagagtcgtgtgtggtttccttatctgttgcaagattattggtatcaatagctgagtgcaagctgacttcccttcattactcatctcttcaaagtcttgaggactgggcttggaaggttgaaatattggtggtgattttctctctgttggcagctcttaataccgcaatgcagcattttgaagtggagctctctactgctttatgcagttctcagtcaaggcctatcttctcttgcttcaagctctcgcaaggtatggtgtttttaatttgctggagtgagtcacgattgttcgatccttgcctcctagtagatcttagttatctcaatacgaaccccattttaattcggaatgaagaggtaatgctatcctggattagctctgtacctctttttgaggatgttacactccctttgagtttcaggttgaagctctctttacctcagtatgaggaagttactcgttgtgatactactttgttacctcagtgtgaggattttatttggactgctgtctctgtggacatggtttcacttatctcaggcgtgtttaggctatggtggttctcctcacagctctcagtctcttcaaagaggtgtttggtcgcctttgagcttgtagctgggtctttcccaattggttactttcagatttgcccggcaaagggaatgtggatgcaaggccgtgtcctccatcgcttattgagtagagtgggctctggacacgtcgtcaaagcggtgatgattcacaaagcctctcaaccagcaatatcaactggactctcaagacttcagattcttccggactcaatcgtccccttctgttccctgcgcttagggatggacttgaatgagattacaggtttcttgagcttcaaaaaccttgttcctctcttcactccgttatcatgtgtttataatctacgcacagcattatgtttagctgttgcttttgcaaagggtgttgtacccagactttgtatttcaagtactctgctttgagttggatatgaaataaaattgttgacaaaaaaaaaaaagataactgttgtatttatcttatagataactatgagcatgtgataagatcaacttgactctatcacatgatctcgacttgtataaatagagagctgcagacatcaataaacttaagctttccacaatacaaatcttatagtaagaacaattggaataatgttttgtgtttgtagagagaagctccgttccctcaaatggacacctattgtttattcatctgcgataaactggtcatggcgttgacaagtacgtttccttacctttacagttttgttttaacttattctatttgatgttatatatgaacatttatacatgtagtattgtggttgctgctgcgactgttcaaaaggagagatcaagaagactttgtacagccatattaaaccaagtgataagagaattagctgttgcatttaaaccaagtgatatgaaattattctcttcttctctcttttgttcttcacattcttcagtttccagcaagtaaaaaagctcatattctcacactcctattcgtcttctttggctcagcccttaaaagatcgacaagaatggaggaggtacatagttttttagcactaaaactattattcttagtttgtattgaaaaaaaaatgttgctggtgaaggaacaatgtcaagtctttcacgtgagagaaatcttgcaaccaaagggggggcataataaactgagactatataagtttcgtttagttatgtatttcttgagaaataatgtaattctttgtttttttttttgttaaagggttttataattcacgtttgtgtgttgagcgtaaataaaagggaccgctttatacgattcagtgatgtttttagtttaatttcagcttctttcttttcatgaaattcaagctacttcacaaatcaaagatgcatgcatatttgcgtggggaactacatagacacccattcaacaagaactctatttataatcacgtcctaatgaatcggtcatttgaacaaaaaaaaaccacttcctaatgaatcggtcatacttttatttttaaaatagatacaaagacacccattcaacaagaactctatttataatcacgtccttatgaatcggtcatttgaacaaaaaaaaatcacttcctaatgaatcggtcatacttttattttggagattaatgtttcataaccaagttgctttggtctagtggtataggagctccagctggagtgcccgcccctgggttcgagccttggccactgcggaatttaacatatgggctgcagcatccgagaccgaaaaccgttacacggtgagccacatggtgacgccctggcagcgtccatgctcacttcggtctctagtctggaccacctcggtggagccaggatactcggttagcaaaaaaaaaatgtttcataaataaaaacagatatcagtgtacgtagtatcctcccttatctttaggattcgattcccaccttcaacattccacttttttctcatttcagtttgttatttaaagggtttcaaaacatacaacaattatccaaaactagattgtttcaaatttctcaaaagatatttaattcgaagctaattatcacgagaactacaaattaattccaaaaatgaagttaatttcattgatgtgcatcgcctttgtcatactcttgacatcattcccggctacggctattacgttcaaccctgcttgcattaaaaatcatgatacctgcggccccctagttgctgtaaagggccggcggtggagacccgaatgttgtaaaatttggagcgggaatgtacttccagaaacaagacaatgtgcatgttatgtactgaaacattctttatttggcaatggtgttcttccccttattttagctaagtgtaaattaggtggtatcgaacaattcaaatgttcggaggtggaaacataaaatagttaactaaccagaatcgtgaaaaccaaactggagataataagataaagtaatcaattgggtatttctttatttctttctaatcattttaataatgttactgttcaataaggagagagaaatggtttgtttttgttcatgctcgtgtgaattacgattccatgtttttttgtttccatgtattttcttatatatttagtaaaaaaatgaaaaggtataatctagtctggattaagtaccataaataaatatttgttcttaatcttagtgctttggacttgtaacaccaactttatgcgtaataagcatggggagaagaagcaaatgaagaattcttcttattcaccaagttttgtaatataataattttcattctaccaaaaaagcctctctctagtattttctctaacttctttctaaaaaagcttccgaccaaatagatttgctcatgtggccagtgggctctttgctgccggtcacccataatctttttgtttttgtttttgctttgtattatatttcttctcttcgcggtggcgataaaccgtggcaaatttttgttgtgtattcaaaatcttaattgaagcaaaacttgatgattgtgttgtgttattcttcgattgagattgatcttttatgtatgcttctcctctttcacagttgctctttaaatcccgttcgctttaatggagttttcttcttctctattggattcgcatgtactcttttcttaagggagtcaattttcactctttaaaagatgaagccgatgaataggctcttaggtggaggtgatgttagagtaatctcgatgaagatttagatgaatcggcatcctctcggagatggtccgataaagatctttaattttattggattgattgagtaatcccagagttattacccaatgaagttgatggtggctctcattgaagcgacagccggatgaaagatagcagatcgcagtctcatcccatgtcagatccagaagtttaaagactcatgcaaaggaggatgagggcgcgtgtcacgtctttcccgtgcatggaactcgaagagcctaatggaccacgaattaggcctaataaaatttattttatgatgatgagtttcaagcttgttgcttctcttgtaatgttcattggtaggcatggacattcggggtcccaatcgggtttcgattttatccattcgggtttcggtttttcgggtttatcaaaatcaaccccattcgggttatataaaagttcggttcgtgaccggttcgggttctatcgggttcgggtcggggttagtaaatcttcaaagaaccggtataacccattgtactttcgggttcgggtcccaatcggttcttcagtttaaaaatacatgatttgtacctattttgtaactaaaacataaataaaatcggttcttcggatttaaaatacatgatttgtacatattttaatagccaaaacataagtaaaatcgattcaaaaataagaaaaaacatcaaacgtgatcattcaaaatcaaacgaaagataaacatagttagtgatataaaaaaaaccttataaatgaaatcataaaacaaaatataagttctcatgaaatgagaaacattattcaataaaaacaaaaccaaaatctaaaaactccaggcatcaaccgccacattccaccatcaaccttcatgtaacagataattattttagaagttcaataatatcttaaagtattttggatacatattaagaattaagatcatatttggtagaagttctttttgtgattttaaatgtttcgggttctatcggatatccatttaggtccgggttcggttcggataatacccataacccaaaataccaaaaaacaggatccattcggtatttatgtcgggttcggatcggttcggattcatttttatcggatcgggttcggttcggattttcgggttcggtttatttgcccagccctattcattgggcctttctaaaggaaagaaacagttgacaaaaaaaaaagaaaaaaattctacctacttaggcccttcttaattcctcaaatccctctttttccaatattacaatttcttcctcttgactatcaacaacagacctcaatgggttcatatcctatggcctcttgggagtcttttttggatagtcatccatactgtgaaggagcattggggtgtgataaggaaaccaaatccctttgtaccagtcaactgctgaatggttagcttccatgtgagctaatcattactcatcctcgcaagtttttagatgactgcttctttttatcaggtggttgagtataatctattttgaattagcctgttggactagtttctcttattcaagaaatccacttgctcagtgacacaagagcagctaagcgggtccgtaactttgttggtaatataaagggaaaactcagatcttctgttttgatctttgcttgtgcgcgtctcagacatgtattgcacatctttgtttcttacaagcgtcaaatcgtttatacatttttagtgaaacaaaggtgagcaggtagccaggtagtacctttccttgcaactcacgcatgaatataataaatcaactatttcattgttgatgactggatgattcacaatcaagttgctgggtatagtatttacactaaatttttttttcttttgtttactcgtgagatcatcaaagatgttttagatatatgaaaagcacatttcatagtctatattcatcttccatgtatgtttctttgatgatttaaaaaaaacagaagtacatcaacacttcttatctttgtgttttcttaatctcaagttggtaaatagaaaaaaatgatgaaaagaagaagaaaaacaaattactacgaggctctcagtaaagctgttctttcttttcatgccaccatctccacctgtaaacacaaaattgctagaaacattagtgaacttttatataattttatataatataaaaaatatataaaaaattattttaaaaaatgaattttaatataattttgtgccaaatcttgcattctgagatcatcaagtcaatgtagtatacgtaccagtaatattcccaacgaggacggactttggtcatgcggttatcatcagatgggtgataaggatgagcagcgtggtgagtgttgtggaaagcgcagcaacctgcagcgtagacggatgttgacaaccgataactttctccagtcaagacggatctcttcaagaacaccagctttacaagcatcacactcgtagcataacgtttcaataccattgttccatctatagcaatcttctcctccgactattactccagtctcgtacgtgcacgccgttggtggcttacaacatcccgactacaatcaaagacaggttagttactaaacaaactgatgaagatgctagttcatatcataggacacaagcggagtttataaccaaaccggaaaaaaaaacaaaatccgatatgaacagttatacaaaaatacctgaacggacctaaaatcattagatatttttggattccgaaataatatctgaaattagctaaatttgttaaacttttacatatttaaggtaatttagatattatcgaaagataaggatgatgatacctgaacagaagtcatatccctttggaaataatcaagtgtggtccaagattcaatcttagaacaagtctttgaagtcaagatacagcttctaatggagttccaatactcttgatctctaactcttgatctcagccacggatgataatctccaagtctatactctttgtaaacccacaccacctccttggctagtcaccacaagaccaaagagcgttagacccatgagagtcgctatgaggaagatcatgacaactaagtacacccacagagcccatgccacgttgaaacaagctcctatgaaaccagcaagggatactaacagtatgatgaatcctatcacgagaagcggtgtctggaggaagttctcgcaagttttactgcttcttgccttccatagagcagttcctttgattggtattgaagctagtaagctgagaaggtttatgaccccaatcactgtgttgctgaacctgtacatagtaggattgttatcaagaagaaaccagagaactttgcagtgtttctcttctctaatcagattctctcttatcaattaggaatcccctggactatatttgcgaagtgattttgccacaagtcatttctacaatcaatttcacaaaacaagtatgacattgctactgaaattgatgatatgtcttatagcttaatatgacatggacaattgcatttaatgttaatttatatttttggtaaactttttaaaatatggtaataactcatataatacatttaatgtcaatttatattttagaaatttttttagaatatgaaaataactcataaatcatcattaaaataaatatattcaaatatgacattataaatttcgaaatataatataattatatatttttaaattatataattttattactaaaattttcaaaaatgtatataatttttttagaaaattataaaaatttaatcgtaaaatcattattttcttatatatctacaaattttataaatattgtttaattttaattgttggtgattatgcaacttttacaaatgtatttaatatatttaattaaaataaatagatagaaaaatctatctaagattataatttcaaatataaacatgcatatttttaaatataatttttatgtttaattaaatcaaatttatattaaaatattgatacgaaaaagaaaatttacaatattaaaaaaacttattttaaaatataatttatatttatctgttaaaaaatattttaattttttttactgcacatggtgcaggaagacacctagttttaattaagggaaaaagttaagagttaattgtttaatgattcatgctcatattctcttgtcgtttcttgatttatttttatttttgtcaagaggtcgtttcttgatttgaatcaactaaacaacaacattaaaattgtattttttttcaaataaaagcgtctttttggacaattgtttcttgtttaatagtattttatacgcttatgtcgtttaaaccagaccacaagtagtgccttgaataaaatatgtacataaaattaaactatattgtatatagaatcagataaattcacaatgatcaatgaaaggtaagcaaagaataatatagaggacggatggtgaattttctttttaagatgcttttactggccccataacttggcatattaggttctgtaggtagagcacaatatgatgtttgattcccacattcactattttttaagcaagaaaaatgctaaaacatacttaatttaagccaaaatgtcataaaacaacaaaataagacaataataacattactgcaacaaatacatagtttttaataccgaaagctagatcgaatcaaaataaaaaaaacatgagtggcaactctaaggttttggcgaatggtgagaatagggttcaaaagtcgggagatcaggatgtgaccatgatggatgtgggggagagagcgagaccacccggagaccctccggacatagggctttcatgggtagccaaggtagcgggtacgagtgaagggggtatgtcggtaccagagagcttgattgatgatgctttcgtgtcggaaaggctccgagtcgagttcccgaatggagaggatggtgaaccgtgtatcacgatcgagacagaggttttggaagcgatgaacgggatgtggaagcagtgcatgatcgttagggtgttgggaaggagtgttgcgatctctgccttgagcaagaagttacgagagttatgggatccgaagggagcaatgtatgtgatggacctgcccaggcagtttttcatggtctgtttcgagaaagaggatgaatacttaggggcactgacaggaggcccatggagagtctttggcagttacctcatggtgagggcttggtcgtcggagtttgatcctttaagagatgacattgtcacaacaccggtttggtgggttagattaacaaatataccagtgaatctctatcatcgatcgatccttatgggaatcgccaagggattggggcagccagttcgagtagacatgaccacactgaagtttgaaagagcgaggtttgcaagaatctgtgtggaggttaatctagcaaagccgttgaaagggacagtgctaattaatggtgagagatacttcgtagcttatgaagggttatctgaaatctgttcaaggtgtagaatttacgggcatttggttcatggatgcccaaaaacgattgcggagaaggtggctaacttggcaatacagacggagacgccgacacttaccaatccagtgcctaaacaagtcccaccaaggcaggaagatggttttactcaagcaaagggatcaagaagaggaacgcaagccccgcgatcggtgaatgttgtgaccggagaatcaaatggggtgactaatcggaagctccaagagattcttaattttaaagaggctaatgagattgcactatcgaataagtatggaagtctggagatggctacgaatgtggatggatcaaaggaggatgtggttgctggtgaagagaataaggagaatcatgatatgaatatccagaacagtaagggaaagggtctcccgcaaggaaaagaagctttaatctttagtgggaaaacaagtacgtcgactagcttgaaagggatgactaaggagaagtgggctgcgaacaagagaataatggagggaggtagaggaaagcccaaaagggtaaataacaggcccattaggggcttggtgtttagtccgacgaagggtgaaatcagtccggtaaaagactgagagtggataacattgatgcagggagatccaggggtgtgtttagtgatggtgtggaggaagtcagaagtatgtctaaacctctgctactacgagatgaagcgttggacaacctgatggagagtactatcagcgaggtggatcagagagtggctgatatacagacgagctcacaaggagatggtaggatcgtgccccttgcatgacagcgtgccccggtaattcgtatagaccttaacagattaattatgatgaattgcttattctggaattgccggggggcaaaaaaactcaatttcagacgctctattcgatacatattgaagaagtttaatactgatgttcttgcactttttgagactcatgcgggtggagaaaaaacgagaaggatttgccagaatttggggtttgagtactcctttcgggtagatgccgttggtcaaagtggtggaatttggctcttgtggagagaccaagcgggcgtgattacggttttggaatcgtcagagcagtttgttcatgctagggtggttaatgggacagagactatccatctcatcgccgtatacgcagcacctacagttagtcgtagaagtagactttgggggcagctaaaaaggatattggagtatatagatgaaccggtgctggttggtggagactttaatactatcttgaggttggatgagaggacatgggggaatgggaggctttcatcagactctctggactttggggaatggattaatgagattgccttggtggatatgggttttaaaggcaatacatttacatggaaacgaggaaaagagacgcggaactttgtggcgaagcatttggacagggttttatgtaatgcacaggcgcgggttagatggcaggaggcggtggtgtcccaccttccgttcctagcgtctgatcatgcaccactctatatgcaactaaaacctgagcagagaagtaacccaaggaggagaccgtttagatttgaggcagcgtggctgaagcatgaaggatttaaagagctgttattggcttcctggaatggtcaaatgcgtactcctgatgcattggtatctctacaactgaaacttaaaaaatggaataaagagatttttggaaatgtgattcaacgtaaagaaaaacttctcggtgagatcaagggtattcaggagcagttggaaaggaatccgaatgatgatctactgtcgagggagggggtgcttcagaaggagcttgatgtggtcctagaacaagaggaagtattatggtatcagaagtctcgggaaaaatggatagttcttggagacaggaatacgaactattatcatacgagtactatagtgaggcggaagagaaataggattgagatgctgaaagacgacgatggccgttggatagatcagtcggaagagctggagaagctagcaataaactattacaagagactgtattcaaccgaggacctcaacctagacacggaaaagctccccccgcaaggctttaccgagctggagattttgaatgaacctttctcgaaactagatatcgagacttctgttcgatctatgtggaaatataagtcccctgggccagatggctttcaacctgttttctatcaagattcatgggatgtggtgggggagtcggtaactaggttcgggttggagttctttgaatcgggagttctaccggaaggcacgaatgatgcaatgttagtcctcataccgaaggttcttaaacctgaaagaataatgcagttccggcctataagtctatgtaatgttcttttcaagatcataacaaaggccatggtgttgagactgaagaaactaatgctgaagctcataggcccagcgcaagcaagttttatccttggtcgactcaattctgataatattgttattgttcaagaagcggttcactcaatgagaaggaagaaaggacgaagaggacggatgctccttaaactagacctcgagaaagcttatgatagaatcaggtgggacttcttagaggatacactctatgcagcaaagctaccacggagttggattaaatggattatggaatgtgtcacaaatccgggaatgagtctattggaatggagagagaacataggcgtttacgcctcaacgtggacttcgacagggtgatcctctgtccccgtacctatttgtgctatgcatggagagactatgtcaccaaattgaattttcggtggcaaacaaggagtggaagccgatcagattatctagaggtggaccggctctatcacatgtttgtttcatggatgatctaattttgtttgttgaggcctcactatcgcaaattcgtgtaatacgcagggtacttgagtggttttgtggagcttctcggcagaaagttaatctggagaaatctgttatcttcttctctgagaatgttcatcgggacctagtgaacttaataagcaatgagagtggcattaaaggaactaaggagttgggaaaatacctgggtatgccgatcctgcaaaagaggattaataaggagacttttggagaagtgattgagaaggtttcctcaaaacttgctggatggaagaagagattcttgagtttggcgggaagaatcactctcaccaaatctgttctctcatctatcccagtccacacgatgagtactatagctctgccggcgtcaactctaaaccaactggataagattgctcgagcttttatctggggcagtagcgaaggtaacagaaagcagcatttggtttcttgggataaaatttgcaaacctaaaagagaaggggggcttggtataaggttggaaaaggaaatgaatgttgctttattagcaaaacttagatggagattgctgaatacatatgatactctatgggtcaaggtgctgcggaaaaagttccgagtggggagctatatgacccaacatggttgatagtccaggggacctggtcaccgacttggagaagcctagtggtgggtatcagagaagttgttattctgggaacgtgttggatcttgggggacggccgccgggttcgtttctggaaagacaattggttgttgaacgagcccctatacgaatcaagtatggtgcatatcccagagccgatcttagaagcaagggcccgagacttatggcagaatggaaccagttggctacttcaagctattgagccgtatatgtcagtatagaatcagttaagactagctgaagtagtgattgatgatgttactggagtccgagatagaatgtcgtgggaagagagcaaagatggattgttttctgttaaatatgcgtatgccttactgactagagatgaagtactgagaccaaacatggaatccctatacagcctggtgtggtgtctagttgctccagaacgagtccgagtcttcttatggttggtaacacatcaggttatcatgacgaacatggaacggaagcgtagacatttgagtgataatgttgtgtgcccgttgtgtagagatggagacgaaaccattctccatgttcttcgagactgtcaggcagcagttggaatatgggtgaaaatcatgattccgagtagacaacagcatttctttagcttacctctattgcaatggctctacgagaatctggggagggacaagccgggtaatggagaccaatggccaacactttttgccttcactgtgtggtggtgctggaaatggtgatgtggctatgtatttggtgaaacaaggacatgtcgagacagagtgcagtttgttaaagaaaagtccagagaagtgttggaagcaaataagcatttgcgagatcgttcttgtgctaggggccgggtggagaagcaaatcgcatggcagcgacccgttaatggctggcttaaattgaacattgatggagcatctaggggtaaccctggactggccacagcgggaggagctgtgcgagacgaatttggaatgtggaaaggaggttttgcgattaatataggtatttgtttggctccgttggcagaactgtggggtgtttactatggactgtgcatagcatgagattgtggtattcggaggctagaggtggaagttgattcagagagtgtggcgggttttcttcagacagggattcatgattctcatcccatatccttcctagtacgtttgtgctatgacttcatttcaagagactggatagtcaaaatttctcacgtgtatagggaggctaattgtctagcagatggattagctaactatgcgttttctttaccgtttggtttacattattttgagtcggctccagagcatgttgcttcagttttgttagaagattgtaacggagtgtccagaactcgacaaatttgcctgtagttgttttgtttttgatttgaataaaaagtaggcctgcagcctaccaaaaaaatacatagtttctaattagaacaaagactaaaccagaccaagagaaaagtcgacaacatcttttaactctgtccttccactatcatcatcatcatcatcatcctcataacttattgttgtaccagaacacacctttcttctcaccttgcctatccggttcaacatagatacactccttcgcctccctccacatcgccttaaccgccggcgttccatcaaactggtaatactctccaaagtatcggctttatcgccttggtcgcttccatcgcgttataatgcggcatcgtcgagaacagatgatgcgccacgtgcgtgtccgtgatgttatggaacaccttgttcaagattccatagtctctatccacagtagccaaagctcctctcaaccaatcccactcggaagaatcatagtgaggcagcgaagggtgcgtgtgctgcaagtaagtgatcaagacgaggaaacagttgacaattagaagcggaactccgtagacacagaccacagaggctactcctcgcgaagcagcgtaacggtagagaccgtaacatacggagaggacgccagcgtcagagatgtatatctggagacgctcgcggtcgttgtagatgggagcgttcgggtggaaatggcaagcgaaaccgtcgctgtaaggtcttcccgagacgttgaaggctaagtacaacggccagccgagcttgaactggacggttagcatcaccgtgcgtcctagcgggttgttgaggtacttgccgtaccacttgatgtcggatttcttcttggggacgaacacttcgtccctatcgagggatccggtgttggaatggtggcgtcatggatgtacttccaggagaagtacgggacgaggaggaaggagtggaagacgaggccggcggcgtcgtccagccactggtggtcgctgaaggcgtggtggccgcactcgtgggctatgacccagaggcccgttaggacgcagccttggcaggcccagtagaggggtcaggcgaggtaagggagagggaagtaggctgtggagaggtggtagagggaggagccgaggaggagatgatgatgtcgaagaggagaaggagcgtgggatggagcgtttgaagcagtgaggtgggattgctttcttgaggtctccgagagtgaatggtggtgtctcgcaggggacgcgtttgagggtgttggttccgggggagctggagggaggagagacttgcattcttccacctgcgcccatgtttgtttctgtagagaaaaccaaaaaaaaagaaaagaaagtaataagttagttagtaggaagaacggaaggggtaaggttttttttaac

SEQ ID NO: 3 - DNA, 28527 bp, Brassica napus
acacaagtatttgaaatattcgaaatcttagatttatctagtaaaacattacatacacaattccaaattatcttaaagtacttaaaaccaaaaaactggtatgaaaataattcaaatttataaaatttataaaatattcaaaatatataaatcatgaaaactgaataaaaattgggaaattctcctaaattgatcattttcaagttttggtcacaaaaatagaccacagggaggaaaatgaccaaaatgttttatttaataggtaaaaagaccttaatacactggatatataaaaaataaaaaaagtaaaaaataaaaaaatcataaaaaaatttatagttttagattatatgttttcaaattcgaaatttttataaaaaattattttttttgaattttttttcgaaattttcttttttttcaaattttatttttgtaattcgaaaatattttttgaaactattttaaaaatttttatttttaaatttttaacatttattttttattttataaaattttaaacctcaatcccaaatctctatcccttaactctaaaccctaaagtttgaattagttaaccatacgtgtataaatgtatatttacctctttcatgaaacagtttggtcattttgatcattagagtctatatttgtgacaaaataaaattagtgctatcctctggtatttctcataaaaatttaataaatttatttaatttaattttttaatattagtttgagtttagaatcttatccaaaagccgaattatcatattatttaaatatttcgtaaaatcagatgaatcaactttttttgtatggattttgggttctaaatattgtcgcccaagttgacaaaaaaaaaagtattgtcgcccaatccacatgacacaatagtattcttttaatcaatgaaccctaaatcccgattgaaatcctaataattgaattcaacccaatagaacaatagtaggcctgcgatttcggttttccgaaaccgaaccgaaccaatttttcggttttcggttaaacggttttttttggaaaaaactccgaagaaaaccgaatttgaattcggttcagtttttggttatttccgatttttgattttattccaaaaaaatcgaaatcaaacattttcaataaaaaaatcggatcacacgattaatttcgggtatttacggttactgttgggtttcggttacctaaggttgtttcggttatgcctctattttcacctgccaaatcaaataatcatgcaatcaacaacggaaaaataatctccaacatcaaaaccaatttataatcgattcaccaagttaaaacatttaaaagagatcactctcaaacatgaaaatccaaaaaaagataacaatctgaatctatatttcttttgcaaatatcagactttgaaagatacattcatacatagattcatgaagttcaaaaagataagttgtccaaaagagagtgataggctaagttggttttggcttcctcgacattccaacctacaagtttatgaagtaagaaaatcagtaaaaacagggagaagaacaaactacaagaaactatacaaataatagagcaacaaattacctttaatgatcggattcactcggaatttgcaaagactctacataatgtcaaaggcagttaggaatatatgactgtggacatataaaaattgaaggaaaatagttaaatgattacctaatgactcatgaaaatcgagttcttcaaacatctgaaccaagcttgcaaccttctcagcctggatgttgtttcgaagccactgttgtaggcagacaagagcttcaatcatgtatggagtcagacaactacgaaacggatctaaaatcctaccacttgtactgaatgctgactctgaagcaacaaaggagacttgaacagctagcacatcttctgctagttcagacaagattggaaacttacaagagttcttcctccaccaagataacacattgtaatccaagccgaagttgtttgagcctcgtggtactggtttttccatcaagtagatgtcaagttcactgcttccttcttcatttgctgcctctgaaaccatctttgaatacaaagaatctctcctctcaaagtcttcatcatcgtcatcagagatatcaaacatggttccaacttcaccttccccattatcaataacgttgctgagactatcaccttgagatgaagagccgagcttgctcacatactcctcatacaacgatttcatcagtgccctgattgatgttctgagatgaccactctccagactatccttcccgtacagcttatcaaaacatatagaagcaaattgcatcttgttccttggatcgaacacacttgcaatgatgaccagtgggttcatattgataagcccatcccagtatttctcaaatttgttcctcatctcctttgcttgaatctgtagaatcccatctttgctattgctcaatgcaatcaagttcctctcgataatcacaatctcattctaacaaatggtggacgtgactgtcttcgatgctgagaacgctaaagtgcagccaaagaagattttcagaaacttcactaacctctgcacctcttcccacccttccgtagtaggaggtccaactctcttctgtccattctcctcttcttccagaaaataatcattatacaacatgtcttcggctttgagcttctcaaaagcaaccttaaacttcaaagcggcagacaacatgagatatgtggagttccaacgagttatgcagtccaaagacaagctccctctactaaccattcttgtcagcacccttaactgaaacgactgcaatcttgtacccgatgatctaacatacttcacagcatttctaatagccattacactatctttgacctcagataaaccatccctaactatcaagttgagaatatgggcacagcaacgcatatgcaacaatgcaccatccttaactaatgcatttggtcctatctccctacatgtttctgtaaacagccgtagggccttgtcattcgccttagcattgtctactgtaaccgtaaagaccttctatattccccaatcagagagacatagactcaaatgctcagaaatattgtcacctttatgatccgtgataggtttgaagctgatgattctcttctgcatattccagtttcgatcaatccaatgagctgtgacgaccatgtagctgtaggatgttgtaggagcaacccaaatattggtggtaagagacactctctgcttctcagaattaaacaactgctttaagctagctttctcccttagaaacattccaaatatgtcttttgttgttgttctcctgcagtgaactgtgtacataggcaagacgttgtgacagaacctcctaaacccttcagattcgacaaaagaaaatggctcctcattcagcactatcatctcattcactgatctcctaaacaaggcagcatcatacttaatggttgtcaatacaccactactatctccacctagcacctgctgttttccaaattctttgtagagctggtacatcttacatcgagcaatgtgattcttcatcgcactcgtcccactcttcttcgagtcacatccaatcccttgggcacaataatggcagttgctgatgcttggatcatcttctctttgaatgaaatgttgccaaacttctgctctgtgagcttgctttttctttgcaacaggaggcatatcagtgcttgatctctcagaagcagatcttttctttcccccaccttgatctatatatgcttcaacgtcttctgcgaggaagttaccattatcttcacaagctgacatctacaaatacaatcagaaaataaacacttaagatcagacaaatatatatacaaaacgaaccaaatgaacacaaaatcatacgctatttcagaaaactcattcgctaaactctgttcaaaatcaacagaaatcgttcctaaccaaagctgataaattgataaactataactgactcattaagcgacacacacacaaaccctaacaattaaaatcccaattcgattatcacacaaagtcacaaaccctaaattcgatttacacataaacttagaaagaagagaagacatatacgaaaactaaccttctaccttgtgctccaaattatgtaaggaagaagagaaattggtctggtctgagaatcagacaaggattgatcggagatcgtatttgagaaagagagattaagagaggcgattagggtaaaccgtttacgactttaggtttgtcggcacttaggttaaggatgacttaggttaggcatacatagttaggttaaaatttcggttatccgttcggttatcacgaaccgaaccgaggaaaaaaccgatatatttgaaaacttgtaccgatcgatttctctgttatttctgaatcataaccgatatccgacgtttttggttcggttcggatcggaccgatcggttcggttcggaataccaggcctaaaaaatagtgttatcatagttacaactaaaaagaaagttaacagacgccgtaaaaaaagaaaaaaagaaaaaaaagaaaaaaaagttaacagacaagtctaaaacatagaaaaggaaatacgagaaggagactagacgcttcctctactaaagcgttttaagagcatgtacaacggtataaatcaggaaatccttaggaaagatccttaatgctttttgattaaagaaatattaaaagaggagggcaaagttaaggatgatccttaattaaggattaaaataccgaagtccttatcgtgcttgcacactttgattggtccgttttgtgttgtctctcgttaggggagagaaaaaacacgggacccaacctcattgtatctcgaacccgaaaaaaaagcagaggagaaggagaggcgacagagaggcgatttgcgatcccgacttgtgaaggtaaaatccgatcttaatcttttttttccttctcgagtttatgcatgttgatttcatcacgttttagggttcgattgaggtgttttataaaatctagggtttgaaatcagattggggatttttatcgatttagggttttcgtcttggtttgatttttttttgcattttcgcatcggttctttgttgttatcgtctggattagaggttctggattgagttcacaatcgatttagggttttggttcttgatttcaatttttttttaataagaatcgtctcggtttgtttttttttcatttttgctttggttgtttgttgttaacgtctcgattagaggtttaatcaattgagttcacaatcgattaaggttttggttcttgatttgaaatttttttttaataagaatcgtctcggtttttttttcatttttgcttcggttgtttgttgtgatcgtctcgattagaggtttaatcgattgagttcacaatcgattaaggttttggttcttgatttgaatttttttttttgcaggttctgaaatggatgaagaacagcgagatatgaaagcacacaaagcatactaccaaagggttgatttcgtatcaaattcgctgcaggggattccccaactgtgcccctgtggatcaatcacgaaggaaattgtagatgaagaggatacacatgactacctccctgggaaaacatacttcatctgcaaagacttcgaggtatgaactttgtttctatctctttcatttattacgggttatatgtttgctatttgacaatttttttccctttggcagaatgacggtctgcattacaggaaaccatgggttattggtgtgcaagaagaggttgagaggctcaaactgaaagttctccgccatgagaaccttcttagagagtgagaggcacttaaggtgagtttattttttttcggtatcataaaaattgtgtttctactatctttctaaccaatgtgttttggtttgtcttatgtctgttaaggaacatgttaaaatgttggtcaagcgggtttctgaacttgaggttagtcttaaaactcaaccgcaatagtttcctggttagagaacatagctgttagaattgaaacggataggactgtcggtaactgtgtagttaggaaaaaattacttcattaaatagaccctaactgcattttggatagtaaaacttcattaaattgtttgtagctgttctgataagacagttttctactaggattcaatgtagaatctcttatttaatcctagtagaatactagtagagaatcacacttcatcttaaatggcaagctctagttttgttaatctcttagcgagccaagggtcagttgaccttaactctgcagagactccattgtttagtacccaaactcctacccaaactccgcaagaaccaagtgtcaaagagaggagaaagtggtctgtgaaggaggatttaatcctggtgggtgtttggctcaacactagcaaagattcaatcgttggtaacgaacaaaaaggtgttgccttctggaagaggattgtagagtactacaactccagtcctcttctcgttgggacagtgccaagagaactagggcaatgcaagcaaagatgggctaggatcaatgatttggtctgcaagtttgctggctgctacgacacgacattgagggagcacagaagtggtcaaaatgacaacgatgtgatgaaggctgccttggatatcttcaacagtgaccagaacatgaagttcaacttggaacatgcgtggagggagcttaggcatgatgtgaaatggtgctccacctatcaggagaaggacaaggataagcgcaaaaccgcggatacttcggttgcagaaccagaagatagaccaatatgggttaaggctgcgggtaagaggaagaaaacaggaaaagatgaagaattaaccaagcttgaagggctggtggacattaaaaagcaaatctcaaggcaaagtttgcttgaaagtttgcttgcaaagcctgagccactgtctgatatggaattagcactgaaaacaaaactgttgtctgaaatgttgtcttgatggtttgttagctttagattaacttgtttgctttattactttgctttgtttactttactgactcgtttggttgttgctttgtttcaggatcagtaaagacatgtgcaagatgaagacaaaagatggtgtcccttcctttttcagtcactggtcatttcgtttgctttttctgtatgttggatgtgtcacgggttgtatgtgtcacgggttgctttgtttttgttgttgctttctattttgaacttctatttataagtcagtgtctgttgctttgtaatttgaacttcccttgtatcatttcatcaatgaaatctctttcctcttattccaagctttgaagcaaacttcccttgtatcatctccaagcttttctcctcttctacttccataaatgtcacgaacataaaaccaacaagtgaagaaagttaaaccattctccaatctttcctcctcttctacttctctaaattcacgacaataaaaccaacaattcaagacacttcaaccattctccaagctctcctctacttcaagtaatttttttattctaaaattagtaatttttttatattctaaaacgtgattagtaattttttttattctaaaattattctaaaacctgattagtattttttttttggcagtatgggagatgaagtcgatcgaagattgaatgcggcattggataaggctgtcgatgaatattttgaagacacatacaacaacatcgtcaagaaccaaacaaagaaacaaaccaaacgtgcatatgtcgaacgaaacagcgaagagggccacagaagtctatggaattactacttcagtgaaaatcctacatttctgcctcatttattcagacgacgtttccgcatgaacaaggcggtgttcatgcgtatcgtcgatcgcctctcaaaaaattttccctcctttcaacaaagaaaagatgcaactgggaggttaggtctatctccactacaaaagtgtacggcggctcttcgtatgcttgcttatggttgtgctgttgacgccgttgacgagtatctccgacttggagaaagcacaacactttcatgtttaaccaatttcacagaaggtgtaatacagttatttggagatgagtatctacgaaggcccactctagaggatcttcaacgactactcgatattggagagatacgcggctttcctgggatgataggaagcatcgactgtatgcattgggagtggaaaaattgcccaaccgcctggaaaggacagtacacacgtggatcaggaaagccaaccattgtcttggaggctgtagcttcacaagatctttggatatgacacgttttttttgtcctccaggtaccttaaacgatattaacgtcctcgatcggtctcctgtttttgatgacattttacaaggtcgagctccaagggtacaatatgtggtcaacgggcaccagtatgatttggtgtactacctcacagacgacatatatccaaaatggtaaacatttatccaatctatctcaaaccctcaaggtcctgaagcagaattatttgctaaagttcaagaagaaatccgaaaaaatgtggagcgtgcttttggagttttgcaaactcgatttgcaatagtgaaaaacccggctattttgtgggacaagagacaaatagggatgattatgcgaacatgtatcatactgcacaatatgatagtagaaaatgaacgcaatggatacactcagtatgatacatcagagtttgaagaaggagagtcgagtagaagttcacaggtggatatgtcatattatctgaagccttcaaatctccttactatgcttgacatacgaagtcgtgtgcgtgacccgcacatacatagacaattgaaatatgatttgattcaaaatatttgtaacaagtttggtaatgatgaagatgtttaattattgtatgtttacattttgtttttcaataaatgaaaattttaaatttcaaattttaaaattttaaatttttaagattaaaaaaaaaaaaatcaaagtactccttgttggataacacaattggacctatggttatgttaaaagtccttaactattgaagaaaaaagaaattataatataactaaggattccatacccaccattggagttgctataagaagaagaaaaaaaattgtctagaggcttcgttttgcgttacttcatcatataggtaagtagagaaccacatcttatcgaattcgacctctctgcttcgctctcagtacttgaaagctcaatcaaccctctcttgtagtaggcaatttcaaatccacggacatggcaaagttcgtcgaaggcgacaagcgatggatcgtggaagacagacccgacggcaccaacgtccacaactggcactgggccgaaacaaactgcctcgaatggtctcgcaacttcttcaacaaccaattctccgacgccgtgatcctctccggcgagtccaacctcttcctcaaaatcaacaaggtggagaagctcgaaggcgaggcctacgtgaacgtgcgcaaggggaagatcatccccggctacgagctcaacgtctctctatcgtggcaaggcgaggcgaaggactctgaaggaagacgatctcgaaggcggaagggttggtggagatgccgtacatctccgatgagaatgccgatgagaatccagagattaggtattagacggtacttataggtgtaattcggtttagtatataccggtagttatggtggtttaagtttactttagtatattacggtacatataggtttaatccggtttattatatacagatggttatggtggttaagattcctttagtatatttcggcataggtttaatccggtttagtatatacaggtagttatggtggttaagtttactttagtatattacggtacatataggtttaatccggtttagtatgtaccggtagttatggtggttaagtttcctttagtatattacggtacatataggtttaatccggtttagtatatacaggtggttatggtggttaagtttcctttagctttccacttgtatttaaactttgatgtgtacatttgagaaatatatacatttcaatgttagggtttcggttaaggacgacggggagattgggaagacgttgaaggaagcgatggtgacaaaagggaaggtggttgttcaggagaaggttagggtttacgtggaggcgatggctagaggtgggccgtgtagggatgagttggagtttaagaaggttgcgccaaaggcaaaggagaagtctagtggtttaccggttgtatctgatgcgaaggagagtaaggtagtgaaagagaagaaggggaagacgaaggaagggtttaagatgattagtatgaccgagaagtttagttgtagagtgaaagatttgtatgagattctgatggatgagaatcgttggaaggggtttactcaagagtaatgccaagattagtagagatgtgagtggtgcgattagtttgtttgatgggtcggttactgggatgaatttggagttggaagaagggaagttgattgttcagaagtggaggtttgggagcaggcctgatggtcttgatttaacggttggtttactgattgtttttgttgtggttcagaaacatggtgctttgatttggatctggttgcgattgatgtgttggctttctttgctttgacattttaggtgagaatcactttcgaggaacctgaaccaggagtcaccattgttaatcttacccagtgacattcctgaagaagataggttagtctcacttaccgaattgatgtatgtagttgttcgactcattaagtctttgctttagtgaatggattctttggaatttgggtgtgctgtattggttagtagtatatgatatagaatactcaacgcacaggccgagaaccattggactattagagattagagaggatcttaaatatcttagccgcccaaacgtctttgactatctatgttaatcatttcctctaattgactcttagtatttgctgcgcatttggagcttatttgtttgtccatgcgctcgttttcttcttttttgttaagcaaatatacttaagagttattcgctcgatattggctcctttgatgttatctgatgggtttccattgacatacgggaatgcgactgtggtggaaaacacggagagaggatggagagaccttatattccacatgatccgtgctgtttttgggtttggaatatgatatgtgattctaattttcaaacaaacaaaaccagcattgcttttatctatggttatgatttcaattccaaaacaagggggactagtgacaagcagcgcaaatgtatgatttctaagttttttgtttatgcattttcatgtaactatttgctcacttctatatttatttaggaatggacaattatccgtaaattttgattcgattttttgtttcgatctgaaaaatcttgatataatcaagcaaaaaactaaaatattatatccgtaaaaaaatgaaacaaatcacaaatactatttgtaatatatatatatatatatataattatatctttttctaaattttataatatttttaaagtaactatttagttattaattttttaaataataggtaattttttaaaaaatcgtaataaaatattattatttatatcagatttttttattattcttttttcggatcaatcggacattcatgtcccgtaaaatacagatttttcagatatctgaaaagttacagattaaattgaatctgaaaatcgattatctgtacggagtagaatggatatcttaaaaaaattatatctgatttgcgccgaccctacttttgttgagattgtttagatcaatggcacacaccgatctatgttaaaactgttgttatcagtattctatcaatcattaaattcagatgggacaagaacttccagtgtaataatactgcaggtcaactacgttgaaataatctatgctcaaaagatatagttataaaccccacaatttgacatgtaagagcatatgtaagagcatgttcaacgcagacatggaaccatatgtaactttttttgttttagtattatttttttagtttgaaaaaaaaattaatttaaaaccgaaccaatcgcgggtcgccacgtgtcagtgaagtccgcaaacagtgataaaaacagagaaagatcgatctttatttgcttacttttgtgatcggttttaaaagttttggtgggactcttgcattaagaaacccagttataaccatggataaacatggtctaagcatatgagcctgatgccttgctaattattagcattaatttgttaaacctgtaggttgggcagaaattaagtactttacaattatcatatttattgaaactagcaataaattagttaaacatcgttcaccaaataatttaattttctaacatcagatcccaaaattcaaatttcgaagattataacctctgtcggtttcgtgcttccgcgccagactaaacagccacatacacaaatactttgtggagcttgttggaatagagatttggaaaaatgttaaaagatttcatatatgatagaatttagctgaatctatttagatttaaggatttaacagagattttgatgagaaatttggtagattttggtcattttggtctccctctataacctagctaaagggagtgaactatccctaatactaagcattcacgttacaacttctcttgatcaggaaatagcaaatatcaaagttagaagacgatgtttacagtttcagattgattcttccacaagctatcgttggtccgtcagtttcggcaagagaagaagcatttcttcgagagaattggtaggaggttctttcacaagatcacatactttaatcatgtgtaagaaaaatttgtgatatttgtctctgttttgtttcaaccatcgttggagagtgaggaaggaagataattgttttatttattttgaaataccatctaggtgattatccgttcacatgcacgaaatgaaatgtatattctaataattgttgaatatgaactttgtccgtataaccataattatatcattcataagcctatatatattaatttgaatatctattaaatgttattttactcatatggtttttattatcatttatattttattataacaaaaaatttaaactatagatcataaaattttcagtgtgagagttttaacaattttcgttatttatagtcatttttaaacattcaaaatataatatatatatgaaaatctattttttattatatggttaatatgattgtttaatttattttaataatataacattaaaaaataatgaagatatgtgaattgttgtcaaatctttattattaaaatcattaattgtcaaatatatattttattcacgtttggtaattccgtaaattttatttaagaaaagaaagaaaaacaataattgtagattgttaattaatttcatggttagtccaagtagaagtatataatatatgtttaatggaccaacatatttctttagagactttaagaaacattttattgatgacacgtgtcaaagttaaaatgttgtaatgcttatcttttaatatatagatgattatctaataattccaataactcttgataaatattatgagtgaaatctttgttttccaataaggagaaatttgaaagagttttaataaatgattaattcaataatagtggatttgatagaacttttataaatactaagaggagatttgaacaaaaactagaattttcttaaatcataagcctcctataagccccctttgttcctatctctttttggtcaccattccattccagaaaatgcttttaaagataacaatcacaacattccaaatgtagaaaagtcacaatctcaacattctaaacctgcttccacctaacaaaaaacaattgccttctcgtagtttactccaaatacaaagggtgtaatataacagaaacactcgacactttaccgaacacacacattgccttctcttctaaataagttcaatcttcctaatctctctctgtctctctctgacaacagagagactcttcacgtgccaaacaaaaaaaactgagcaccttcctctcgccatggccacggactccgtcaagcacgtgcctacattcggcggggcagccatctccgccgaaatgaaaagcttcttctccgccgtgcctacttttgtctacgccttcgtcgtaacctttgttgccttcactgtttacttagccttcgccccttctctcatcactgtctctaattcagtttcttcctatatcctccctaatgtcagtgccgtgacttcagcgtccagtaacatcacattacaagcaaccacgccggaaagtctcactccggctgttataaacacaacctttgagcctcccctaggtaatgaaacaaacccactttctagaaacaacgcttcacgggatcatgcaagtgtacacttatgtcctaacaacaatactgctcgaaattcggacaaacaagcacctctgtccgtgaattcaagtgcttcttctccgatgagaaaacaaagtaggaagtcaggggctaaacgagagatcaagtctctgaaggactgcaattttttcgaaggagaatgggtcaaagacgaatcctacccgctttacaaacccggcacgtgtaatctcatcgacgaacagtttagctgtttaaccaacggaagaccagacgttgagttttacaaactgaagtggaaacctaaagaatgcactttaccaaggctgaacggaggcaagttgctggagatgattagaggaagaaggctcgtgttcgttggagactcgctgaatagaaacatgtgggagtctttggtttgtattcttaaaggatcagttaaagatgagagacaagtctttgaagctcatggaaggcatcagtttcgtcgggaagctgagtacactttggtcttcaaagtaagtttgcaatctgttttggtgaggcctgcgggttcgggtagtttgggctgggtcgttcggttcgaccaaaatattgcccaactgaaccgaacagagtttggttcggtttaggtagttcggtttttcaacttcttttaccgaaactaatcaaagtttttggtttcaattatatgttggtttaaaatttctttaaattcagggtaattttggttagttcggtttgtcagttattttgatttgaatttttgattaatttagttagcttttttttgaaaacccgagctaaccaattactgaagtgaaaaccgaagtattttataaacttgccgaattgaaccaaactaaccaaaaaaatttggttcggttcggttatcaacgcaggcctagtttgactacctagttgttattggagacttgatttgtgtggttgatatgataggaatataattgcactgtggagttctttgcgtctcctttcttggttcgagaatgggaagttacggataagagcgggacgaagaaggaaactttgcgtctagatatgatgggaagctcatcaaagcagtacataggagcggatgtacttgtgttcaataccggagcttggtggactgatgacataacatccaaagggtagagttctgtcagctattttttgttttttttatatggaggatttgtctcattggctttttggtgtttaaatggttttgattagtgaggattattttcaagaaagaagcactgtttacccgaaactcaacgttgatgaagcttttagaaaagcattgactacttggggtcgatgggttgataagtatgtgaatccaaagaagtctcttgtcttcttccgcggattctccctgtcacatttcaggtatgtacagttctttcatggtagtcttaagattctgtttaaaaaaataaataaatgggtttggtctggttgcatgcagtggtgggcgatggaatgcgggaggggcgtgcgatgatgaaacagaaccgatcaagaacgaggcatacctaatgccttacccttccaagatggagattcttgaaagagttctaaggggaatgaagacaccggtcacgtatctcaacatcacgaggttaacagattacaggaaggatgctcacccgtctgtttataggaaacagaaatttactgcagaagaaagcaaatcaccgttgttgcaccaagactgcagtcactggtgcctcccaggtgtacctgattcttggaacgagattctctatgccgagatgctggtaaagctcgaccagctccgtggcaacagacggcggaaacctaaagggctactataggaggagttaaatcagatttttgttttagatgaaatacactatatatattttcaatggatgaaaagaaaagaaacacttagaagcaattatatgttttcaaaggcatagagaaagtaagaggtgagaatcatattagtgccttgctcatcacttttctagtttttagattgtaaatggttaatttttattttactcaatttaatagtaaaggtttgtcaaatcataactgaaccggaaatggaagcaatcatttggttaaaagaatccagttgatgacatcgactggcaaagcataggcaggatcaatttggtttgactccaggatactccagccctgcacacagttttggatcattaagttctctttagctttgaagacctgaacagtatgaactaatgagaagcaaattttagtcacctgcaactccaaagtaagtgtgaaagatatcaacagcatcgtcaggtccattctccatatcttattcaaattacacctgaaactcaggaaagactctaaagagatgtgagctttataaaccaatgtttgagaaaaacctgacagtccaagatgaactttacaagctttgatttgtcaatccaatgtactctattggtcatgataaagctcgataaaacccaccaagagtggcaaacctggtgataattaagcaagaacaatcagtgtggtaagaacaattggaataatgttttgtgtttgtagagagaagctccgttccctcaaatggacacctattgtttattcaactgcgataaactggtcatggcgttgacaagtacgtttccttacctttacagttttgttttaacttattctatttgatgttatatatgaacatttatacatgtagtattgtggttgctgctgcgactgttcaaaaggagagatcaagaagactttgtacagccatattaaaccaagtgataagagaactagctgttgcatttaaaccaagtgatatgaaattattctctccttctctcttttgttcttcacattcttcagtttccagcaagtaaaaaagctcatattctcacactcctattcgtcttctttggctcagcccttaaaagatcgacaagaatggaggaggtacatagttttttagcactaaaactattattcttagtttgtattgaaaaaaaatgttgctggtgaaggaacaatgtcaagtctttcacgtgagagaaatcttgcaaccaaaggggggggcataataaactgagactatataagtttcgtttagttatgtatttcttgagaaataatgtaattctttgatttttttttttggttaaagggttttataattcacttttgtgtgttgagcgtaaataaaagggaccgctttatacgattcagtgatgtttttagtttaatttcagcttctttcttttcatgaaattcaagctacttcacaaataaagatgcatgcatatttgcgtggggaactacatagacacccattcaacaagaactctatttataatcacgtcctaatgaatcggtcatttgaacaaaaaaaaaaccacttcctaatgaatcggtcatacttttatttttaaaatagatacaaagacacccattcaacaagaactctatttataatcacgtccttatgaatcggtcatttgaacaaaaaaaaaatcacttcctaatgaatcggtcatacttttattttggagattaatgtttcataaataaaaacagatatcagtgtacgtagtatcctcccttatctttaggattggattcccaccttcaacattccacttttttctcatttcagtttgttatttaagggtttcaaaacatacaacaattatccaaaactagattgtttcaaatttctcaaaagatatttaattcgaagctaattatcacgagaactacaaattaattccaaaaatgaagttaatttcattgatgtgcatcgcctttgtcatactcttgacatcattcccggctacggctattacgttcaatacttcgttcaaccctacagattgccttaaaaatcatgatacctgcggccccctagctgctgtaaagggccggcggtggagacccgaatgttgtaaattttggagcgggaatgtacttccagaaacaagacaatgtgcatgttatgtactgaaatattctcttggcgatggttatcttccccttattttaggtaagtgtaaattaggtggtatcgaacaattcaaatgttgggagctgcgaacatataactaaccagaatcgtgaaaaccaaactggagataataagataaagtaatcaattgggtatttctttatttctttctaatcattttaataatgttactgttcaataaggagagagaaatggttttgtttttgttcatgctcgtgtgaattacgattccatgtttttttgtttccatatattttcttatatatttagtaaaaaaaatgaaaaggtataatctactctggattaagtaccataaataaatatttgttcttaattaatcttagtgctttggacttctaacaccaactttatgcgtaataagcatggggagaagaagcaaatgaagaattcttcttattcaccaagttttgtaatataagaattttcattctaccaaaaaagcctgtctctagtattttccctaacctctttctaaaaaagcttccgaccaaatagatttgctcatgtggccagtgggctctttacagccggtcaccataatctttttgtttttgtttttgctttgtattatatttcttctcttcgcagtggcgattatgttatgattatgttattcgcggtgccgataaaccgtggcaaatttttgttgtgtattcaatcttaattgaagcaaaacttcatgattgtgttctgttattcttcgattgagattgatcttttatgtatgcttctcctctttcacagttttttttttttggtaatccagggttcccagtttcgcgggtcattccctgggtccggtcaggcagcgggtcggcttcacccgggagggtatgtcctgagcccgaaggtccagtacccgcttcgtgacatggatgagcagttcggctccggctggcgtcgaacccgcaagcatgacaattggccctcaaggttctaactagtagaactgactcatcccgtctcctctttcacagttgctctttaaatcccgttcgctttaatggagttttcttcttctctattggattcgcatgtactcttttcttaagggagtcaattttcactctttaaaagatgaagccgccgatgaataggctctgagtgaagtttcctggatagaaaggtggagtaatctcgatttgatttgatgaagatttagatgaatcggcatcctctcggagatggtccgataaagatctttaattttattgagtaatcccagagttattacccaatgaagttgatggtggctctcattgaagcgacagccggatgaaagatagcagatcgagaagttcaaagcttgttcggtgaccatgagcagtctctgccgccggcgaggtgtaccgacttcctctcatcccatgcgttggtgcgacagatgcatgtcagatccagaagtttaaagactcatgcaaaggaggatgagggcgcgtgtcacgtctttcccgtgatgaagacacatgcactattaggcctaataaaatttattttatgtcgagttgtatgatgagtttcaagcctgttgcttctcttgtaatgttcattgggcctttctaaaggaaagaaacatttgacaaaaaaaagaaaaaaattctacctttaggcccttcttatcaacaactttgacaacagacctcaatgggttcatatcctatggcctcttgggactcttttttggatagtcatccatactgtgaaggagtattcggggtgtgataaggaaaccaaatccctttgtaccagtcaactgctgaatggttagcttccatgtgagctaatcattactcatcctcgcaagtttttagatgattgcttctttttgatcagatggttgagtataatctattttgaattagcctgttggactagtttctcttattcaagaaatccacttgctcagtgacacaagagcagctaagcgggtccgtaactttgttggtaatataaagggaaaactcagatcttctgttttgatctttgcttgcgtctcagacatgtattgcacatctttgtttcttacaagcgtcaaatcgtttatacatttttagtgaaacaatggtgagcaggtagccaggtagtacctttccttgcaactcacgcatgaatataataaatcaactatttcattgttgatgactggatgattcacaatcaagttgctgggtatagtatttacactaattttttttcttttgtttactcgtgagatcatcaaagatgttttagatatatgaaaagcatatttcatagtctatattcatcttccatgtatgtttctttgatgatttaaaaaaaaacagaagtacatcaacacttcttatctttgtgttttcttaatctcaagttggtaaatagaaaaaaatgatgaaaagaagaagaaaaacaaattactacgaggctctcagtaaagctgttctttcttttcatgccaccatctccacctgtaaacacaaaattgctagaaacattagtgaacttttatataattttatataatataaaaaacatataaaaaattattttaaaaatgaattttaatataattttgtgccaaatcttgcattctgagatcatcaagtcaatgtagtatacgtaccagtaatagtcccaacgaggacggactttggtcatgcggttatcatcagatgggtgataaggatgagcagcgtggtgagtgttatggaaagcgcagcaacctgcagcgtagactgtgatgaggaggactaggactagaatgttgacaaccgataactttctccagtcaagacggatctcttcaagaacaccagctttacaagcatcacactcgtagcataacgtttcaataccattgttccatctatagcaatcttctcctccgactattactccagtctcgtacgtgcacgccgttggtggcttacaacatcccgactacaatcaaagacaggttagttactaaacaaactgatgaagatgctagttcatatcataggacacaaggggagtttataaccaaaccggaaaaaaaaacaaaatccgatatgaacgggcctaaaatcagatatttttggattccgaaataatatctgaaattagctaaatttgttaaacttttacatatttaaggtaatttagatattatcgaaagataaggatgatgatacctgaacagaagtcatatccctttggaaataatcaagtgtagtccaagattcaatcttagaacaagtctttgaagtcaagatacagcttctaatggagttccaatactcttgatctctaactctctctctcagccacggatgataatctccaagtctatattctttgtaaaccctccctggtacttccacaccacctccttggctagtcaccacaagaccaaagagcgttagacccatgagagtcgctatgaggaagatcatgacaactaagtacacccacagagcccatgccacgttgaaacaagctcctatgaaaccagcaagggatactaacagtatgatgaatcctatcacgagaagcggtgtctggaggaagttctcgcaagttttactgcttcttgccttccatagagcagttcctttgattggtattgaagctagtaagctgagaaggtttatgaccccaatcactgtgttgctgaacctgtacatactaggattgttatcaagaagaaaccagagaactttgcagtgtcttctctcttctctaagcagattctctcttatcaattaggaatctattggactatatttgcgaagtgattttgccacatgttctttctacaatcaatttcacaaaacaaatatgacattgctactgaaattgatgacatgtattatagcttaatatgacatggacaattgcatttaatgttaatttatatttttggtaaattttttaaaatatggtaataactcatatagtacatttaatgtcaatttatattttagaaattttttagaatatgaaaataactcataaatcatcattagaataaatatattcaaatatggcattataaatttcgaaatataatataattatatattttaaaattatacaattttattactaaaattttcaaaaatgtatacaattttcttagaaaattataaaaatttaatcgtaaaatcattattttcttatatatctataaattttataaatattgtttaattttaattgttggtgattatgcaacttttacaaatttatttaatatatttaattaaaataaatagatagaaaaatctatctaagattataatttcaaatatatacaagcatattcttaaatataatttttatgtttaattaaattaaatttatattaaaatgttgatacgaaaaaagaaaatttacaatattaaaaaaaaaatttaaaatataatttatatttatctgttaaaaaatattttaatttttttacacacctagttttaattaagggaaaaggttaagagttaattgtttaatgattcatgctcatattctcttgtcgtttcttgatttatttttatttttgtcaagaggtcgtttcttgatttgaatcaactaaacaacaacattaaaattgtatattttttttcaaataaaagcgtctttttggacaattgtttcttgtttaatagtattttatacgcttatgtcgtttaaaccagaccacaagtagtgccttgaataaaatatgtacttaaaattaaactatattgtatatatagtggaacatatcatatatagaatcagataaattcacaatgatcaatgaaaggtaagcaaagaataatatagaggacggatggtgaattttctttttaagatgcttttactggccccataacttagcatattaggttctgtaggtagagcacaatatgatctttgattcccccattcacattttttttggtttaagcaagaaaaatgctaaaacatacttaatttaagccaaaatgtcataacacaacaaaatgagacaataataacattactgtaacaaatacatagtttctaattagaacaaagactaaaccagaccaagagaaaagtcgacaacaacttttaactctgtccttccaccatcatcatcatcatcatcatcatcatcatcatcatcatcatcctcataacttattgttgtaccagaacacacctttcttctcaccttgcctatccggttcaacatagatacactccttcgcctccctccacatcgccttaaccaccggcgttccatcaaactggtaatactctccaagtatcggctttatcgccttggtcgcttccatcgcgttataatgcggcatcgtcgagaacagatgatgcgccacgtgcgtgtccgtgatgttatgaaacaccttgttcaagattccatagtctctatccacagtagccaaagctcctctcaaccaatcccactccgaagaatcatagtgaggcagcgaagggtgcgtgtgctgcaagtaagtgatcaagacgaggaaacagttgacaatcataagcggaactccgtagacacagaccatcgaggccactcctcgcgaaccagcgtagcggtagagaccgtaacatacggagaggacgccagcgtcagagatgtatatctggagacgctcgcggtcgttgtagatgggagcgttcgggtggaaatggcaagcgaaaccgtcgctgtaaggtcttccagagacgttgaaggctaagtacaacggccagccgagcgtgaactggacggttagcatcaccgtgcgtcctagcgggttgttgaggtactttccgtaccacttgatgtcggatttcttcttggggacgaacacttcatccctctcgagggatccggtgttggaatggtggcgtcgatggctgtacttccaggagaagtaagggacgaggaggaaggagtggaagacgaggcccacggcgtcgtccagccactggtggtcgctgaaggcgtggtggccgcattcgtgggcgatgacccagaggcccgttaggacgcagccttggcaggcccagtagaggggccaggcgaggtaagggagagggtgggggaggagagggaagtaggctgtggagaggtggtagagggaggaggagacgaggatgtcgaagaggaggtaggagaaggagcgagggatggagcgtttgaagcagtgaggtgggattgctttcttgaggtctccgagagtgaagggtggtgtctcgcaggggacgcgtttgagggttttggtttcgggggagctggagggaggagagacttgcattcttccacctgcgcccatgtttgtttctgtagagaaaaccaaaaaataataataatgttatggaggacggagactttttatcctttaatcaaagttgtatatgcaactcttcatgcatttgaatctataaaagaacatctaaaccctgaagtacctacctactttaaatcatccgttttatttgtacaaagttgatgagcttataagtcaatgaaacgttcttccatttattaagaaataacagtagcaagaaccagtaggaatcggtcaaatctatcaaaggttcaacaataagtgatttttatattgaaaaaaaacaaaaatagcactaaaccaagtttttgttcccaaactagcactcaaggtcaaaagtcacaaaaatatcacttaatattttatcaaaagtcacaaacttatggtttagagttaaagggtggggtttagggtttagggtttagggtttagagtttagggtttagggtttatggttcagagtttagggtttagagttgagaaatgaggttttggggataagatttcaaattttgaaaaataaaaaattaaaattttcaaaagataaaataatattttggtcattttaatttttgagtgctatttttgtgatataaacttagaaagttgctattttggagatttgaccttttctatttcaccaacctattgaataaaaagatttctgaatagatagaaagttgcaacatttcatatgctagaccatagacagtaatcattatttaacggtgagatgaaagaaacatgacacaagatttgtcaaatggaaacagaggaacagatctttagttgaatgcaataaagactggcagatctatcgatttaaatgccaaatgctagactgctagagagatggacgagatgaacacagaccaggaattcataaaaataagaggaaaatgagaagaagaagaagaagaaggggaccctgaaagctgctgacgtagggtggggggagagagattttacgttaataacgatgaaccctacaatgaagctcctccaaagaatctatctctctctcttctctttctctctctctctctcttgtctcggcacttctctcaatctgttgtggtttgtctggtcagatgcgagtggcaataggcagggccgtttttaaattgatgagagacaggaaggcatttgaatgacatctcttattcttacaactggcccctcttttctcttatttttacaactgggcccctctgttcaaaatatctgatatttaactcaaggaacgaccattaatttagaatttaccaaaatgtaaaagttagagtgatgaaaaggtgatattactacgacgttctctctttttctcgtccacgttatcttggttatgtatgtaatgtaataaaaaaggtcgtatcatgttattgacttaatcactttggaacgcaatgacacatgcggtacttgtttgaatcagtttttctctacgtaagtcaatcatgtatcatttcttaatatgacattagaaacaacttgataaagaagaagaagaagaagatggtagttgatgcctgaaaatggagtatcgtgtttggcttcttctcacttttgcccatgtgaacacacaagaacttacagaaatatgtaacagacaaattgtggtgatgctcacgtgaggatttctctctcttttctttttcttattacaatttgttatgtatgtgtaatcatctttgatacttataataatcaaatttgttggcagacgaaaagaaactagtaattgattagattgagatctcttgtattatactagacttagaagatgattagagtttgatttgtctaagcattacctctaacaacaacacacttttctttcaaaattttttgtttaagatcacacacccaccattaggaatgttatatttattcagctgattgttactaccagtgacgggttttataacatgtttttttggtatcaaagatgatgtgtctgactcacgcacaacagacaaatcagagcaagcatgactgtaagaaaattaaggcagcatacaaatcctaaccaccgtctgtcaatccatccaccaagtctctcatcaattcaaactcaatttaacagcaaaaaaactatattctaagaatcaccacacagagagaaagaaaacttacaaagacaatgaaactaacattgtattttcataaaacaaaagcaaaatagatgaagaagatggatgatattagagatcaccaccacacacaaaagaaaagacagcaaactccacaaacagcaacttaggcaattcctgacctgcgcagctctgcttccccgtgcgcaaagtgacacctatccccaaacgtacagttccctttcgcgaacctctcacacatcttcgtcttgaagttgctccctggatgtggtttcccttccgaaccaaccccaccaccaatcccaccaccaccaccaggtggtctcctactagctgcagagttaagcctcccaatcagctctctaaccatcacactcgcttcgtttatctgctcaaacgtcccttcaagctcaatgttcttcaggttcgggtccctctcgtgatcttgaatcgacagcttcgcccccgtctgacgacatatctgcttcgaactgactcctcctttaccgatgatggctccggccaacgaagcgtccacgctgattttcgcagtggctgaggcgccaaagctagacacatggccaggtccagactctcctcctctccctgagaatctccctcctccaccaccaccaggtccttgcatgtttctggaagcttgaggcatgggtagtgccatgtttgtcagctgtgctacagcattgtatcctccgggtacatagtgcaagaagtggcagttatctccaaaaggacagccagaagtgctgcaatagagcataataaagacatcagatagttaaaaccatttcccttaagatgacacaagagaagttgagaacaaacggttaaaatacagaggaagtatcaattgctatacacaaggaaccaattagtcaccaccagtaatgtaataaacttacctgaacctgaccatatatgaccatgttataaacacaacatcactaacaccttaccaccaaacagaaaattatagcaattttctaaacaagttatagtttgatttcgaacgttatgatcaccaattgagttgaacgtttctatgattataatccagatgcacttatctcttattgaaacttttttttaacttgtttaggatcaatgatttataagtacctgtaataacaattaaccacttcattagcatacagttttacttgttaatttgacaattaacaattttcaatattaatccagttaagaaaaaaaaggattataaatttataacctgaaaaatttagtgcaaggcttggatttgctgcctaaaccagttgaatatgattccatctctgttccaaacatttaagtgtgtttttattctttagttaagagttttctcaagttcaataatatgacaccattcatacttttcatccatatgaaacttgagacttaagaattaaagctgcatgataccttctgtaaattttcaggacacatcaatccgacaaaggaaaagacatgggctgtcttactcaactgaacatggtttactaaaagcaaaattggaactaaagtaacttcgaaaaaaaaacat

SEQ ID NO: 4 - DNA, 26095 bp, Brassica napus
acatcttcctcggaatataccgagggacacctttccttggaatataccgagggacatgttcctcggaatattttgaggaagatgtccctcggtatatttcgaacgtttttttataaacggatcgatcgatggatatatgtccaaaaacgcatcgatcgatgaacttccgaggaaatatcccgacgaagttctccctcggtatattccgaggagattttcgacaaactagtgatcctcggaatttcctcggaaatttgtttcctcggaattccgtcggaaaattccgagggatttccgaggaaagaagaaattccgaggaattatttccgaggacttgtttcgtcggtatgtcgtcggaataacgttattccgacgaaattccgacgattttttccctcagtatccttgctgttttcttgtagtgcaagaaagctaatagatattagcaagtaagaagacataagtacttgatggccaagcaaaagcctagaattggaatatcacgacattcaagcaaaaggagaagacatattccaacagagccagagccatgttcaagatgagacaaacaaatgtgggtctataaggggacataaagcaaaaactcaataaaaagttaggctagtgcctatatcagctggacacatgggagaaccaggtccatgctatataacaatattatcaaaagcagtgttttcatataagtaggagtaactttcttccctagtccactctgtggtctaaataaccaccagaggcactacacaggatacaaacaaaagttgaaaacacacacagaatctatgtatagagagtgacaaagaaaaggataagaaggtacttccattgaaagtacggagtgtctgatatatattgaatgtataactattgtaattatcagtcaacaaagtcctcacaaagtcaagcctttccatagagtcttttttcggtagactcttgttagcaatggatgaatcttccaagtgccctggcgcaatatgtttcgagatcgcttgccaaacccaacactccagctgatccaccatgactctctccatcctccactctacaaccctacaacccgctcgacaccgtctccgacgttctcaacgccgctttcttccgttaaatctcccgttcccgtctttacccaaccaaaagcaatctcaagtgctgtccaatctcaaacggaggcgaatacttcatgagtatctcaatcggtactcgaccaacagccttcagatcgtcaaataacataagagagttagacgacgcttggattaagccgcttctatcatgttctatgcttggactcagacagagtatatgacgactatttcttatcaatacatataggcccaaacaatttaaactcaacaactgagcccaataaaaaacttcgaataaatgaaacgatgagtttcataatactgggacacgtggcacaatgatgtaaagtgactttcctaactggaatcctatgtgtcacaatgaggagggagtaaaacacttatttatataattagataactatgtatataacacataatcggttgaatcgaatgttttggttcagatctcagtacataaccaaaccgacccggtgtccgaagtgcttagagctaaaaacccattcggtatttgcctggtcccgttaccgaaccggacccattattttggttcggtttaaggtgtggactccggtttaagttaaaacccccagccctagggtaaatgataaaacatttggttgtgtatctcctcggtggtatggaaaacgtaatagaatccgaacttactagaccggtacgcgatttatttttcgtcttacgtcgtaagatgtcgaataaggaaaaagcaacgtcattatacatgttaatccggttatctttgatccttttcgaggacatttcggtttacctttttgtttgttcaatacgccactccggtttaaaaaaaaaatcgggaagagttaggaaaaaaggaaaatctcatctcaccccctcgacgacaagacaaccaccacccttagggttaaaaaggtttatttatctgattattattctctctactcgttcgttctccctttaattccgatttcgatttcgatttgtcttctccgatttgctctctagacactcacagtagggtttctaattcggatctgtacaccttttgccatggatgctcgtaagagaggacggcctgaagctggctcattcaactccaatggcggtggattcaagaagtcgaagcaaggttagctctttcgcctcgtcctcttacttttctatctcaaaagagtgttatagttctgttgtgcttcacttgctctgttaaaggttgaaactttagatctttattgcttgatggatagtttctctgtgtcaattggatttggggtagcgatgatttcttcaattcgagcttcgtaatattttttgctcaacaaaagtttttgtttttagttatgagattctctaggattcaagtttggatctttctttcgtgctcacttgctgcagtctttgatctgatgcaaatctaaagtcaattaatttttcagtttaattgtggatgagcttttgataagtgatgttaaagttagtttgagtgctgttcgtagcaagcttattgttatttgactttctcttgagtttcattattgctttagtttaatcccttttgcattagctagtaacatcttatcaccatgcccaaagcttgagtttgctgtgattgaattagcctttttatgtgttagttattcatgtgtctagttgttggtaaataatcctgaaaattctagagaatatatcttgcagctttgatttatgtgtgaagttacatatagatgaatttgatatgtatgattctaaaagcaaatattattgaacatcagcaaagtcttaactaaagaaaaacacttaatctttggaacagagatggaatctggtttaggaagcaaatcgaagccatgcacaaaatttttcaggttataatccttttcttaactaaattaatatttaaaattgttatttatagtctgagctttaaattgacaagtaaaaatgtatgctaatgaagtagttagttgttattacaggtatgcatcatccttcatgctaaacaagttaaaaaaaagtttcagtataacaaatatgatattcactaggaacggaaaaacaaatctggattataaatttagaaatattaagctcaactggtgattatagcttagaaaatcaatccacaccttttgtttgagctgtggcagtagttaagatatgtgttgtaattctctgtttggtggtaagatattagttattgtgtttgtatcatcatggtcatatagtgtctagtaaggttgttgcattactgaatactggtgaacatgtccgtcatagacaagcagttagcatagttgctatgtgccaattcttctgtgtttcaactgtttgttctcttgtgtcttctcaatgccaatggtttttaactttctgacgtatttgttatccttcttttgcagcacttctggctgtccttttggtgagaactgccatttcttgcactttgttcccggaggatacaatcctatggcacagatgacaaacatgggatcacccatgtctcaagtttccagaaacatgcaaggtggtggtggtggtgggggccgattttcggggagaggagagtctggacctggccacgtctctagctttggtgcctcagccacagccaaaatcagtgtggatgcttccttggcaggcgcaatcattggaaaaggtggagtctgttcgaaacagatatgtcgtcaaacaggagcaaagctatcgatccaagaccacgagagagatcccaacctgaagaacattgagcttgaaggaacattcgagcagatcaacgaagcgagcgcaatggttagagagctgattgggaggcttaattctgcatctaggagaccacctggtggtggtggcggtggacttggttcagaagggaaaccgcatccagggagcaacttcaaaacgaagatgtgtgagagattctcgaaaggaagctgtacatttggtgatagatgtcactttgcacacggggaagcagagctacgcaggtcatgaattgcgcctagagttgctggtggagttagagagtttgctggcgaaacaagtctctttcatttgttgtggtgattcctaatatcatcttctcctacttgtttttagttgtctttgttttttgagactacaatgtttagttttcattgtcagtgtaagttttccccatttggtgtttttttagaatctagtttgaatttgagatggggggatgcttgatgaatgattgacaaaacagtggttaggatttgtatgctgtttctacttaatatttcatgttttctctgctttattttggtcagtaagttcatgtgtttctctgacatgtgtgtgattatcagctttgattattttccgagtatgtagatgttatagttctcttatgatagacaatataactaaaaattcatgttaataatagccgtcgctgatagtaacagctgaataaatgaaatgaaatcatggtaggtgatgatcttaaaaaaaatgttgaaaataatgtgcgttgttacaatagcatctcctaaccacttttatatatgtctctataatagcatttagatttagaagtaaaatcactgcaatcctactttatttcttcctctaaaataaaaattgttattttcacggaaatacattcctttataataaaaacatacttttttattcacaaaataatcttttaattttttattttaacaattataaccaaaataaatattttttaatgaaaatgtactgtttatataaatatataatcatactttttatttacataatagtttctataaaaatattcagtataaataatatcatagttttatgaatgttacactaaattggattggttttcaactttcacaaataaaaagtactatttataaaattagaaaaaaatatatcaagactattcttttttagaggaagaaatagaagaatacattggaaacaaatctatctctattatatagttttcctattttagaaaaaaaaatagagaaatacattggagatggtttaagcggtagtaacacaaagaaaaactctaaatatcttaagagcatctctaatgtacacttctgtaatttcttctaaaatagagatctctattatagaggtgaaaatgctccaatgtatgcctctataatagaattcatctattttaaaagaaaatatagagaaaaattactttttgcttttatatttaaaggtggaaataaaatatctctatataaataaataaactctattatacatgtatacattggagcattttcacttttataatagagtttttttattttaagaaaaaatatagagatagaaatagaaatagaaatagagatgagttggagattagaaatagagatgagtttgagatgttgttacgtaagaaagagctagagctttaataaagtacttaaattaattactagtcggcagtcgctgcctacttgtttaccacctaaattaatttattataatatatattacgaatctccaaagtacacatcacacacactctactcacgtgatctcaaccacaatgtctgcagatattttttatagttttttctcacatgggagagaagaagccaagcacgatcctccatcctcaactttatagcatttttttcttttctttccggctaccacttgtgagtcgagtcggcaagggcgtttccttatattaaagtaaagacatcaaataccatcgtcttaatgctaattaacgtaattgatgagttctataacataatccaaactagtctttgtgaacattaggattgggtaaaccaatatttacattttaaaaacaaaatacaaaaagaaacgtgataaactttataaaagcaattatatgatcactgcatcttttccacttttccgtaaataaatacataaaagtgccgtaaatatcagatatttggagtagaaaagtaataaagaaaagaaatatgaggagagggaataatggagggggcccacttgtaaaaaagaaagaaaagagatgtcactcaatcgtctcccacgggcccccgtcaatttaaacggcctgccttctgcccaatcgcatcttatcagaaccagacagattcattaccaaagagatagagaagagagagagagagagagagagagagagtgagtttgaggaggagcttcttcgtagggttcatcgttattaacgttaaatcttcaccccctacgtcagccagctcaaggtccctttcttcttccatttcttttcattctacgttgttttcaatcttatgaaactttctggtctgtgcttttcttatcgcttttctattctatctatcatttttgcatttcagtcgatttaattctagatctgttaatattaaactatagatctgttcttgattctctgttttcatgtgtgaaatctgatgctgtattaatctgattatattgtctataccgtggagaatatcaaatgttgcattttcatttgtccgaatacaaagtgtttgactttcaatcgtttttaattatatatatatatatattttttgatgggttggtggagttgaaaaatcaccatagcagtctcacgtcctggttttagaaatatcctattcaaaattatatatttgtttacttgttttagatctggacctgagacatataagtacctatttgttgaatctttgggtaaaaacttatgtctctgggtaaaatttgctgggagatttgaccgattcctattggctcttgattctgtagttacgtaatacatgaaaaagtttcatttggcctatgctcacttcatgcttataaacgttttcttgcaaattaattggattagatgttatttcatagattcagtcattcagatacaatggagttgcatgaagaaaataatagaattcgtgacagtaaaaaagattgtatttttgtttgtttgtttatgtttaaaagtctatatgttgacaatagagttgctctcaactgtttcatttagcttctttttttgtcaagttgcttattcttagagacattgtgattatgacttgtcttctttaacgtagtttagtaataaaagacgaaagaaattgatatccacaagaaagagatgtgagctgtagcgtatcaaatctcgttcatttactagtagtattctcaacgctatcgtttatttatttttctttcgttggtttgccactatatgccacttctctcctctttgtcccacgtactatccattttttttgtggtagtccattttcttgtaacttataataacgtaactctgaatcttttgtctgtagattaatttgttggtttaattaacttttaagtctttgcttttggcttatgcagaaacatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccgttgtacttagccttcaacgtctcgggaagaccttacgacggcggcttcgcttgccatttccaccccaacgctcccatctacaacgaccgcgagcgtctccagatatacatctccgacgctggcatcctcgccgtctgctacggtctcttccgttacgccgccgcgcagggagtggcctcgatggtctgcttctacggagtcccgcttctgattgtcaatggtttcctcgtgttgatcacttacttgcagcacacgcatccttccctgcctcactacgattcgtccgagtgggattggttgaggggagctttggctaccgttgacagagactacggaatcttgaacaaggtcttccacaatattaccgacacgcacgtggcgcatcatctgttctccacgatgccgcattatcacgcgatggaagctaccaaggcgataaagccgatactgggagagtattatcagttcgatgggacgccggtggttaaggcgatgtggagggaggcgaaggagtgtatctatgtggaaccggacaggcaaggtgagaagaaaggtgtgttctggtacaacaataagttatgaggatatgatgatggtgaaagaacaaagaagatattgtcacgaacctttctcttgctgtctctggtcgtctttgttttaagaagctatgttttcgtttcaataatcttaactatccattttgttgtgttttctgacattttggctaagttatgtgatgtgggacacgttagtgtctaaaatgtctctgtgtctgtattgttcttctcatctgtgactttcggacaactaaactcttgttctcgaactacctcaatgtggcattaatgaaagtgttattgttgattttaatctgaaactgctattatttagtgaatttttacatcagccaacttgtttgtttaagacctaccaatggtataagaaggtttgtgtactaatgttcaccatgtccatagtgttaagacataaccatgatcttctgtccaattaatttgcgtcgagttatcgtgttatttggcacctttactatgtttttttgtaaagaactccttacagaatagctttttgtaaagaactacgttttatctttttgtaagaaccttttaacaaaagccaaattcattattacctggcacaagaaaaaactctggtttcttcctctttctctgtttttagatttgaggaggaacatgaagatgaagaaaaagaaacaaataaataacaaatctctttttttccattaacggcagaaacaccaaaacagagtgacaacaagaaacaaatgtagtgaggaaaaaccaaagaaaaaagaatattctgaaaccaactcgttgaacatattcaaatacgaaacaatctttcatccaacggcgagcgtaatctagaagcatttcctgtggactatcgatggccctgcctcatcatactcagcctttgctatccacatctgcaagaccaacattgtgtatcatagtcagcttaaaaacgagtaacaagcagaatcgacaattttacctgttggaaggtactgagtgatgctagaatagatcctccaatccaaacactatacttcctctccggtggagcaaccaccttaatcttcatactactcggagccaaagcagtaatctccttactcatcctatcagcaatcccagggaacatcgtggtaccaccactaagcacaatgtttccatacaaatctttcctaatatccacatcacatttcatgatcgaattgtaagtcgtctcgtggataccagcagcttccattccgaccaaagacggctggaaaagaacctcaggacacctgaacctctcccctccgatggtgatcacctgtccatcaggcaactcgtagctcttgtcgacggatgagctagtgttcgccgtctccatctcttgctcgtagtcaagtgctatgtaagcgagtttctctttcacgtctctcacgatctcacgctctgctgttgttgtgaacgagtagccacgctcggttaaaatcttcatgaggtagtcagtgaggtcacgacctgcgagatcaagacgcagaatggcgtgtggaagagcatatccttcgtagattggaacagtgtgactcacaccatctccagagtccaatacaatacctgaaacaatgattccacatcaataaaagtgttctaccttttttttatcaacaaaagtgttcttctaccttataaactctctagataattataacataataataataaataatttataattataataattaatattttttagtataaaatcttatgagaataaacaatataaatattattatttgtaaatatttaaactcttatattattatttttttccaaccactacactcttatattacatatattgttataattggtaaacaactaggtcgaagataggcattgagttaccgtctcagcgctaaaatgtctactaaaattatattacattacattgagaaagctaagatgaacatcataaaccaatggtgtttgaagatcttaccagtagtacgaccactggcgtagagggacaaaacagcttggatagcgacatacatagcgggggtgttgaacgtttcaaacataatctgagtcattttctcacgattagctttaggattgagaggagcctctgtgagaagaacgggatgctcttcaggtgcaacacgcagctcgttgtagaaagtgtgatgccaaatcttctccatgtcatcccagttgctgacaataccatgctcaatagggtacttgagagtcaagatacctctctttgactgagcctcgtcaccaacgtaagcatctttttgccccataccaaccatcacaccagtgtgacgtggtctaccaacaatgcttgggaacacagctcttggtgcatcgtctcccgcgaatccagcctttcatatagagatttggaggtaagaaaattaaaagattttcagacagcattatattaaacaaagttgttacgtttatgattgattaccttaaccattcctgttccattgtcacacactagtggctgaatgtcctctccatctgccattttctaatgattctgaaactatatatatatatatatatatatatatatgtcaatgattcaattgattacaaaaacacaataacattcttgaaaaaaatcaaatgaacatgaactcaaacaaagatctctgattcactcacattgttacaaaatacaaaaaatcaatttaacattttaccaaagaaaaacaaaaaatcgagaaaagtctggtaatttatttttacctgatagtttgcgaggagaggaaaaatagtacgaagagaacaaagagaagagcgaacgaagaagagaatatataggaagagtctttctgagaaaagaagttttattttattttaatggtggaagaagatccgagccgttgatatttgtaagatgtgaccgaagaaggaccccacgacgagtcatgttgatggtggatacagctgtctcataaagagtaacgacactccatttaattattttattaatctttcgaaatttggtaacgtaactgaaagtatctactctgtaaagtattaaatgggctggaaaatgttccttaagggacaaatccaaccaaaaattagttattaatattaacgggctgaaaaatgcttgaataaaaagttaattattaatattaacgggctgaaaaatgcttgaatgtgatatgttaaccctactaattttaataaagtttactagattctgccagtatatttgtttttattcagaaactagggctggcccgccctacggacggaatgaatatttaaaaataatttaaattgttaaaataagtatttaatgaaaatttttattaattaaaaatataaatattagttatatttctttttcttggggtggcattacatataataacttatgtggtgcattattaatattgtgtaagttgtgattgagatgtaagagtgaagttgtgatcgagaagttattaatattgtgtaagtgagaagttattaatattgataatttatattatttatttaaaatcttagggggttttaacttgtttttgttttttccatttttgttatgtttttaactttaaaagtgtttataaattataaactgctaaattcccattgaaattttgtgattgaaatttaaatatttataacaaaatacaaataattacaaaaacatacgtaagatatatttgtattgtattttttaataacatataccatataaaaccaactaattatttaaatttagattttaatagctgcattgtattttttaataacaattatgaattactaaaaacatatactatttgaatttttattaatatatagtgatttccaacagaatatgcgaatgattatttttatctgaaaatgagaaacattttgactaaaatattgtgtctcgatacatgtgaccacgtcaatttaatatatcggatcattaagtgtccaaatattttgtaatgttattttctcagtttcataagataatttgaatatataactttatttctaatgttattggttagtgtattttaatagatttagaaatccaaattaaatatattattattagttatataattgtaaaatatatattgaaatcatgtgttactggtggcatgatttaaaaattctaattcaaaacaagtgttattcaatcatactatttattaatagatttgatttcataatggatttgaatagatttgtatatatttctttgttaaaatataaattctcaaatctgaaggtaacccgaaagaaaaccatcggatttgtaaatactaattttttttttttttttgacagcaagaaatttacagactcatgttgactctgtaaaccatattggtaactccgcatccatgtgaacgacaaaggacagttgcttgcgtgcactacgtgctaagctatccgcccgaaggttcgccgtccgaggtacatggacgatgtctgagttgaggaagtttcctttgaggagtttgatatcttccaagtagcttccaaatgctggccattcttctggttccgaaaccatcttcaccaattgagaacaatccgttgcaaacgtaacctggacctgtcttaaattcctcatacatttcattgcccaaatcaaagcctctatctccgaatgcaggggagagaggcatgcccttacattccttgcccccagtagaccctcgaaccccggtaaagtactatgccagccttgccctgacattaattctttatccttccatgatccatcaataaaacaccatcgacctgatgtctctaaaggaggaatggtttgtaccgaaagccccctccttggttcatttctcacttgtgcgtctgcccagagtgatgattccacttcagccaatttaagagtatcccgcggatcaatatccaaattactataaactttgttatttcgggctttccatatataccataaaatccatgcaaaatggtggtcatccatttgcggttgtactctccaaaaaagatgatccatattaacaaataaagagctgatagggaagatattatgcggtgaaggaatcttggatagtgcccacacttgacgtgcaggaggacattcaaaaaatacatgatttattgattcttccggatctccacaacgagcacaacatatatctcctctgatccctcgtgcctttaaatttttcatcaccgatatacatcctgataccatttgccacaagaaatgccgtatctttggtggacaccgcactttccagcagaaagctttaagtatatccactgtggggccattaaaaacaggaggttttaacctatcagggtaaatacgttcaacctgataacctgattggaccgaatattttccattattagtaaaatgccatccatccttatcctccatctgaatcctacttaaagggatactttcaataattcttacatccttcggatccactagagccctgattgcctgtatattccatgaacgagattcctgattgatgagggaatccactgtgagttccggataaaagttgtgaaattttttatttgctggtctcgggcgagtggctgggatccaaggatcattccatacagagatagatgatcctgttcccacccttttaattagtcctttacaaaccagagatctagcagaagtaatactcttccagccatatgacggggagtaagatcggatcggttccaggggtgaagcattcctgtaataccgtcctttgaaaactcttgaaaaaagagtatttggtttctcaattagcctccatagttgcttaccaagcattgctgtattaaaatccataagatccttaaagcccaaaccaccattatctttggtttcacacactttatcccatgatttccaatgcatacctcttgcactaccccctggactccaccaaaattgtgctacagcacccgtcagcttcttaactgtagcttttggtaacctatacacagacatcacatggtttggtaaggccgtaatcaccgatttaataatcacctcctttccaccttttgtaaaaaaacgaaaggtccatccattaacccttttattcaaccgctcttgaacaaatccaaacacttgtacctttatgtatatttaaatttgatactaatttaaatttgtatattaaattttaactttatgaacaaatccaaatactaatttaaatttgtatattaaattttaacatatgtatattttactttgatttgtaaatattatttggatttctgaatcaactaaaatacataaactaaataataatatattttctttggaaattttaaatgtatggactattaaatcatgcaaatactatgaaaaacaaattgatctacaattggtataaaactatttccatgtatgagatacaatattgttacgaacctaaaattatagtttattatactatcacctattactgttatttttgtaaaacaatattttaattttagatagaacttcaagattactcttttggtaactgttgccttaatattcccggttctattacatcagccattgaaataaaatgttactaataaagtaagttactgctggtaactaaaattcagaaaccgagatgacttaactcttctattataacgtagatttatacatttataaaacagatcttacataatcaacttcttcacatcagactcacttacgtgacctttttctaggatttccttgtgagattgggtttgttcagttcctagactcagtttcttcgcctttgacccttctattcttcttccataaattctcctttccattttctcaactcttgttctacgcctaactcttcttctttagctttctcaatttcttctgcaagtgttttttgcttcttcctctccaagttaccttgtctatttctctagcttcctcgatctcagaacaactgttgcaaccattgtattggcttcttcttcagcatcatgagcacgctagctaagcagacggcggctaatgccaacctctctgaacccttagcagccttagtttattcctaagttgcaaataaaatggtctccattgtacttgccccagcctttgcttgctctgcttcttcttgagactttcgaagctcttcagtgaatgattttgcactgtgacagtgaaaattttttcttcatcagcctttgtgttgctttctgcggctgcttcggtagctccgctatttatcttatggcttcttttccttggactcagaaatagctattctcatgttatacgaccatcactcgccagcaaaacaaacctggataaacataaggcattgtttactaaaagcatgagaaatgaaactaaaaatcatctttcttggctttttttcaaaaaaaaatatggtaacaaaaccataaactccgaattatcacaatatgcttaattctatggagggacatcaagagaatctacgaatgatatcttttttgaattctctgtaatccgtaaccataagctatcagtattgtgaaacactaacatctaacaacctaaaatcagacaacaaccccacaaagttgtagttttatgacaatacaatgaagcatttctctcccaccaaccatcaaagagtatgcaaacctaaagccaactgaagcatacaccttaagattaaaacttgggagaactgtaaagtagacctctggttttggggtgactttaacagcaacctcctgacccttgagctctctttcttgaacttaggctagcagagcaagtgcaaccaaaatgacctctcccgagctctcccatctgaaactgcatacctctgtattcagaaaacatactgacaacacgttagtttgtagtaactaaaataaagagagcccagcaaataattattattttacagaaccagacaacatcaaaatcagatatatttttttgttaggtagaacttgttgcagttttgaaaaatagtaataagaatttgctcactctttatgatgaagatgtactaagacaccgtccctctgcaaactgctgttgatgtccataatacttgtattgtatccatccttcaccgtgaagtttgtttatgtttggcagaatgacggttagaatggaaaagtgtttggttattcaaactctaaggcagctgtatcttctttttaggcttgttgagctttttcttcttctttctacaaaaacatgtcacagactcagagttagccaagttcggtattactaaagcaagaggcctaaacaacacagaactgcagataagttaattgacccaccaacttccactcatctgcctagcactcctcatcctttactcgtgtgtagcttcttcagcctatgccagacagtatgaagaaatttttattaggaaaacgttgccacgtactaacgctacaatcttaaactttcacagttagggcctgtaactgttcgactgatattcatgtagtttcccatccttgctacttggttacatatgtgaattagatagaacaatcaacaaacaaataaataatcaacaaaaaaataaaaaatctgtaaaacttggttaaatgattcaacacaacgcataagttcaataacataatcaaggataaaaaaagttggtaagtggattcacacggcggagtcgttacaaatataatcaaattttttttaatagattgataggatgctttagattgtagggatgctaaccttattatagtggaacctccactgattgatttctagattggatcagtaggaaaaagatgaataaattgctccaaactctagattcgctactgcgcagattgattgatggatcagtgaatggatagaaactttagaatttcttactgcggagaagagagagcgtgaaacgataaaataagaaaagcggcgtttcaaacccatcatattatgctttatatcgatatgggctttaataaagtaaaatacacatacgaagccaagcccaacggaatccgatgaaaaaacaaatgaaacggagcgtttaataaggtggacacatgttaacgcgagagagctcgactttcctagctggaatctgacgtggagccctcaggagtgaggtgactctactttatatataaagatttagaaatttaattttcatgtttgtctttttctttgtaatcatatttgtgtttttctttgagatcatatttgtgtataaattttaatcaaaatctatttataaaataatatcaatttaaaagttgatctgacatacgctcgtatttttgtaatcatatatgttcgtatgctcgtttttttgtaaccatctgtgtctattctagattttgatctccacttttaaagtgtatatttatttgctaaacaaatcaaatttatttgatataaatttgtatttttgatttttaattacatttaaatgttacaaataaagcattataattgtgcagattgtaatatgttttctaatagaaataattttgatgatgaaatatgtaaccaagttttactaaaatcaagatatttttgcatttttagtattttgaattattaacgtaatttataatatttgtactcgaaaacctatgtagcatctacctgtaagtctagccccgaatccgattaaatacgacctatatactcaaaaatattggtttcttgtattgatctaaattttgctaaatttaatttataatataattttcatatattttctcgctatttttatatttgatcataatccacgataaaaatggtaaattaagtgatctgcatataatttatctcagattttggattaaattataaaatttatttttaaaaactccataaaattcggttaaacccaaaaaaaattattgacatgtgatccgataatggttgacccgaaaaaaactagataaatctaatggtcacctatatgaaaatattatcactacaagaaaacataacattaacgacggcgaaattcgtagtaaattcgtcgtaaaacaggttttacgaggaattagcgaggaaacaagtttcgtcgttattcgttcgtcgtaacgcatatttcctcgctaattcgtcgtaaaatagcgagaaacacaattcgtcgtaaagacgaagaacaatattcgtcgtaaaaaccatgtaacctttccacgtaaggaggacgctagatttcctcgtaaatacctcgaaagtaattcctcgtaaattacacataaacctttccacgtaatatactcgttaagctttcctcgtagtgttgccgtaaaagttttcctcgtaacttcttcgcaaactttccacgtaacgtagtcgtgctttaggcggatttgaatgctaccagcaaatttatagattttaagtgttgttatacatacgtagacatgttctctatttattaaataaatagtaacaatgtcaattaggtatagaccatggccatatttttagctaacagataaaaaaaatatttgagaaaaataatatatatgtatttctggtcatgagaaaataatatgtgggttaaatcatttatcatatagtagaagggagtgggttccgccggttacaaggaaaatgatcacctcgtttgtttcgagtaaaaaagttaggtaactgtcataccttttataatgtggtggttacattcggaaattaaaaaaaggttgcagttatcatataaaaatgtatgtgttgttgaaataatagtttgaccctacgtttatcaattggttacactaatagaatagatttatcaagagtagtatactgtatttttgttgttacgtttgtttcccgacaaacttaaattttattaatacgaaagcataatatctgaatacaaagttggagttaaccacttaggtggataaactttacaattttcaaaaatagaatttgttggacaatgtcgaacaattttatggacggcttgatttccattacgtttgacaaaaaaaaatgttgttgtagaaaacttattcctcaagctagtaatttcttcaagaagattttgaatggttgaattcgttagttgagcattgatcattttaaccaagatttctgagtctccttcgaaaatcatattgctatatcctcctatccaaacattctgcattgccacaagtaaagccaactaaactggaattagagaaccccaaattagctgaaccccacatataaggatgaccataacagttccaaataatccatgcacctcgaacttggttcgaatttaaatcatatgctgcatcgtaattacattttagaaaaccttgatctcgtcgtgtccatgacgataaagcaggaaaagaagaaattgtgcttgtattgcttacattaggagatgataaacataaatgagatatccattctctaacgtcagcacaagcattgtccactgtgacatttgggggcagtatttgtttcctaaagagaagaaaattcctctttttccatatacgccatagcaaccaaaaaggtaacaaccgttgataaagcgaaagagattgtatgctttgaatatgcagcagaaaccgattttattgtccatataatcatttgttaataatggagccgtaaaaggtagatatgaaaatctccaaatacatattgaatctgagcacgtacaaaaacaatggtcaattgtctcttctgccaaactacatctctgacaaatagaatctaaattcattcctcttgaatttagtcgtgtagttgttccaatagcctttgatagaatacgccaaaaaaatggttaagtttgggcattatatttaatttcctaatcttatcctttagaataggatcaccataaggaattggaggagcttcaatcaaaaactctggtgcatgcctagcaaccttatatccagaagacacaggatagttttcatctcgtgtatgactccaaatcaacttatcttctttttttgtttggcttaaatatatctggcttacgagacgttgatcctcatcgcataaataagactgtagcgccaccgtattccaatgtttgtaaggtgatactgtaatcatattactaacacgtaaatcacaattaattgttgtagaagcaggtcgaggtggaataacaggtaaccaattatctttggaagctcgtatatttttgccatttcccacaatatagctacatcctttctttaaaacctcaataccagcgagcagagttgcctatccatatgactgcttgcgacatgtttttccttctagaaattgttttcctttaagatatcgagctttataaagtttggaaaagaggcaatttggttttgagtagattcaccatgcttgtttggcaagcaaagcatcattaaattttggtaaatctttgaatccaaatcttccttcttttttcgtatactgtagtttttttcaagtcatccatggtaaacctttaagatcatttttaccccaccagaatcccattaagatggcatctatcttttgtgttgttgcaacagggagtttaaaatgtgacatagaatagataggggttgatacagcaaccgatttgatcgtaacttctttaccagctgatgaaaacatacataattacaagactcgagagccaatcaagtccaataaggcgtttaatgcggtcaacgcttcttgacttgaggctcttatatgggcttacatcagtggcccattaaggtgattcttgtgtacttttaagacttgttgaatttacacatttgaggatcaaacagaaagctaagtatggagagatccgtttccttcgatcttagcggcgataacgaactcccgaatgatcggagcagcgacgtcggatacaccgccaatgatcggaggctcgcttactcccgctcctttcaccactcccactcccacggcccgcgaacgcccgcagctaagccttttctcgataggacggtctccaccatcgatatgccgccggagatatactctgtcgacggggatgatgttttcttcggggaagggaaagcggcggcgattgggaaagcgtcggctttgcgtatggttttggtggtttttggggtgctgagaaatggaaatcggcagatgaagagattgtttctgctgatttcgcttaacgtggcgtattctaccacagagctgttgattgggttattgactgggcgtgtaggtacgatttggttccagcttttaacattttgttacacttagtttttagttcgtggtaactttgtgtgtgtgggagagacttttggatttgttgaagaactaaggttttagtagtggctagagatatagatggaaagtgaaatgaatcagctaaagccccaagattttgattccaagtcttaatttgatataatctgaatcatgaaactaaaccaccacatggatagtagatcttgtgcgtgtatccagggaacttggctatgcagctgtaatttctgattatttattaaccttactctctttttttggctgttttatttgactcttacaggtttggtttccgatgcattccatttgacatttggatgtggtctcttgacgttttctttgtttgcaatggcgacttcaaggaagaagcctgatcatgcttactcgtacgggtaagaaatatgtaaaatttgatccgcttagtttgttttgtattagggatataggttggaatgcatgctttgtggtagttaacggttgatttctcaatttgtcaaattattttttcttttctttctctctggagcaattcctaaagtagattcgctaatgttttcgtaggatatagtatttatagttgctgaatatgaaaccttttctgtttgatttttttgctgctaatactgtaattgcataatgctgaattggttggaacttagaaatcgttgccttttttggttaccaggtacaaaagacttgaagttctatctgctttcactaatgctgtaagtatgttcttaaagtttgttggatcatggatgtcatttccagttttaatttgaaggtctaatggctgatgtgccatgcaataaaactggtttaatatcgtatagaaattagtgtcctgagcttatctcagtgtttgcacactttcctttactgttgttggtagaatagaataatcttacagctcgttaaaaatgttgattatcttttcattttgccttcatcactgtctcattcattttatcttttgggttaacacattgatatgttcagtattgacatatgtgtagacagctgtttcttatgttcatgtcgttctccttagctgtggaagctcttcatgcatttgttcaagatgaatcagagcacaagtaagtttctttccccaagtgacatgcctaagagagctcgtagttatttctctagcacttactaagtttacactaagttctttgcattaatatgatgtattgaaattgacttcatgcaggcattatcttattgtatcagcggtaacaaatctgctggtgaacctacttggtgtttggttcttccggaattatgctcgtatgaatattggtatgtattctctgttttataattatgcttaagttctggttagacttgaatgaactgatgccaatactggtgatttatatcatatagccctgtttggcggctttggtatatttcgtttgtaaaaactggccacccctgtcaatgtaaagcaacaaagaagcaaagggtttctaattaagatagaataagtaggaggattagttaaaatagagagacagaagcatgatgactgaatctggccttctgtacatattcaaaactcacatttttcttgaatgtgtttcttaaattcataaaatgatgcagtgtacagaaaagcagaagatatgaactaccactccgtttgcttgcatgtcatatcagattccatccgcaggtgtgatattctttttggctttctttatctcaagcagagccgcagatagctagatagaaaaatgtttctctttgcatggaatttacatacatcccacatgacatattcgctgcttctgtcttttcagtgcaggtctgatactggcatcctggctcctctctctggggtaatgctcacttcctttaaaaggaacaaaatgaataaaaatgtcttattacctgacctcttacattttccatttttctcctccggtctttggatttttcagggttgaaaatgcagaggtcctatgtttgggattggtatcagttacagtgtttatgcttgttatgccactcttcaaagccactggtggcgttttgcttcagatggcacctccaaacattccttcttccgcattaagtaaatgcttgcgtcaggttcgctctgttccataaagtgtttcctgaacgtgtacatatagatcgatcaacctgggtttctcttcaactatctttatttacagattacttctcgagaggatgtcatagaggttttacaggcacgtttctgggaggttgtgcccggtcacactgttggctcactcagaatccaggtactagcttccttactgttttcatatcggttaaaacacgaatccataataagaattgtactgattttgagctggttatttgtgtttaggtgaagagcgggatagatgaaaggcctttactgcaatatgtgtatgatgtataccatgatttgggtgtacaagacttgacgctgcaaacagactacagctgagctgcatctacttctatgttttcaaatactgaggactttggatgtatactagtagagattatggttctataagaagatagcacttggtttcaagcttgcgagtttcttgttacatttgtttagttttattttttttaattccttttcccattcgtcttttgaaccacacacacaaggaccacaatctttgtaaactcttttagtctttcaagtttgtgcgtctttttggctcaaattctcctttttaatcctttttcatgtaaaaaaatcatctgcaaaatgtaaaatcaaaacggtagcacgtaaaattgtcagctgaaacaagattttattgttcttcttgtttacacagaaaaaactaagtggaggaatcaaagatcatattgtgctcctcaacctacacagcctaatattctgcaagttatggggacagtacaagcatcttaaaaagcaaattcatccgtccatgtctatgttattctttgcttacccccgtttgcttcgttgatcattgtaaatttaacatagtttactaaacgatacaaaaatttgtaaacataaaaaaaatgatacaaaaatttaatatagtttactaattgactacgtgcacatgacaaaggaatttttattaatggaacttgaaaatatattttggatttaactgaactacaaaaacgcaagatatatatgaaaagtatctcaattatttcccgtaacgagtcaacaatttcaaagtatacaatacccacatatgatacgatccattatataatccatgattgcgttttttggactctaagctagaaaaatgtatattaataatatggtatatcatatttaattaaggcactacttgtgtggtctgctttattgttagttaaacgtataaaatagaataataaacaagaaccaattgtccaaaaagacacttttatttgaaaaaatactatttttaatgttattgtttggatgattcaaatcaagagacgaccagagaatatgagcatgaatcatcaaaccattaactcttaacctttccccttaaaaaaaattcccagttgataagatagaatcaaaagcagaaaaaaggtagagttaaacaatataataactaaaaaacaaagaagattgtaagataaagctgatgaagttcacattacaagaagagaatctgcttattacaaaagagagagatataagagaatacactgctaagtctctggtttcttcttgataacactttcactatgtacagattcagcaacacagtgattggagtcttaaacctcctcagcttactagcttcaataccaatcataggagccgctctatggaaggcaagaagcagcacaacttgcgaaaacttcctccagactcctctactcgttataggtttcatcatactcttagtatctctcgccggattcataggagcctgtttcaacgtggcatgggctctttgggtttacttagtggtcatgatcttcctcatcgcgactcttatgggtctaactctgtttggtctggtggtgacgagccaaggaggcggtgtggaagtaccagggagggtttataaagagtataggcttggtgattatcatccatggttgagagagagagttagagatcctcagtattggatctctataagaagctgtatcttgagttccaagacttgtgctaagattgaatcttggactacacttgattatttccaaagagacatgacttctgttcaggtatcatcctcagtgcctagagccatgttaaaaaaaattaaccgtagatttttatatatgtctaaagtttttattgatttataagtattaataactccagttatatatgttttttttt

SEQ ID NO: 5 - DNA, 1161 bp, Brassica napus
atgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttagccttcaacgtctcggggagaccttacgacggcggcttcgcttgccatttccaccccaacgctcccatctacaacgaccgtgagcgtctccagatatacatctccgacgctggcatcctcgccgtctgctacggtctctaccgctacgctgctgtccaaggagttgcctcgatggtctgcttctacggagttcctcttctgattgtcaacgggttcttagttttgatcacttacttgcagcacacgcatccttccctgcctcactatgactcgtctgagtgggattggttgaggggagctttggccaccgttgacagagactacggaatcttgaacaaggtcttccacaatatcacggacacgcacgtggcgcatcacctgttctcgaccatgccgcattatcacgcgatggaagctacgaaggcgataaagccgatactgggagagtattatcagttcgatgggacgccggtggttaaggcgatgtggagggaggcgaaggagtgtatctatgtggaaccggacaggcaaggtgagaagaaaggtgtgttctggtacaacaataagttatcttgctaa

SEQ ID NO: 6 - DNA, 1134 bp, Brassica napus
atgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgaccaccagtggctggacgacgccgccggcctcgtcttccactccttcctcctcgtcccgtacttctcctggaagtacatccatgacgccaccattccaacaccggatccctcgatagggacgaagtgttcgtccccaagaagaaatccgacatcaagtggtacggcaagtacctcaacaacccgctaggacgcacggtgatgctaaccgtccagttcaagctcggctggccgttgtacttagccttcaacgtctcgggaagaccttacagcgacggtttcgcttgccatttccacccgaacgctcccatctacaacgaccgcgagcgtctccagatatacatctctgacgctggcgtcctctccgtatgttacggtctctaccgttacgctgcttcgcgaggagtagcctctgtggtctgtgtctacggagttccgcttctaattgtcaactgtttcctcgtcttgatcacttacttgcagcacacgcacccttcgctgcctcactatgattcttccgagtgggattggttgagaggagctttggctactgtggatagagactatggaatcttgaacaaggtgttccataacatcacggacacgcacgtggcgcatcatctgttctcgacgatgccgcattataacgcgatggaagcgaccaaggcgataaagccgatactttggagagtattaccagtttgatggaacgccggcggttaaggcgatgtggagggaggcgaaggagtgtatctatgttgaaccggataggcaaggtgagaagaaaggtgtgttctggtacaacaataa

SEQ ID NO: 7 - DNA, 1161 bp, Brassica napus
atgggcgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggccgttgtacttagccttcaacgtctctggaagaccttacagcgacggtttcgcttgccatttccacccgaacgctcccatctacaacgaccgcgagcgtctccagatatacatctctgacgctggcgtcctctccgtatgttacggtctctaccgctacgctggttcgcgaggagtggcctcgatggtctgtgtctacggagttccgcttatgattgtcaactgtttcctcgtcttgatcacttacttgcagcacacgcacccttcgctgcctcactatgattcttcggagtgggattggttgagaggagctttggctactgtggatagagactatggaatcttgaacaaggtgtttcataacatcacggacacgcacgtggcgcatcatctgttctcgacgatgccgcattataacgcgatggaagcgaccaaggcgataaagccgatacttggagagtattaccagtttgatggaacgccggtggttaaggcgatgtggagggaggcgaaggagtgtatctatgttgaaccggataggcaaggtgagaagaaaggtgtgttctggtacaacaataagttatgaggatga

SEQ ID NO: 8 - DNA, 1137 bp, Brassica napus
atgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccgttgtacttagccttcaacgtctcgggaagaccttacgacggcggcttcgcttgccatttccaccccaacgctcccatctacaacgaccgcgagcgtctccagatatacatctccgacgctggcatcctcgccgtctgctacggtctcttccgttacgccgccgcgcagggagtggcctcgatggtctgcttctacggagtcccgcttctgattgtcaatggtttcctcgtgttgatcacttacttgcagcacacgcatccttccctgcctcactacgattcgtccgagtgggattggttgaggggagctttggctaccgttgacagagactacggaatcttgaacaaggtcttccacaatattaccgacacgcacgtggcgcatcatctgttctccacgatgccgcattatcacgcgatggaagctaccaaggcgataaagccgatactgggagagtattatcagttcgatgggacgccggtggttaaggcgatgtggagggaggcgaaggagtgtatctatgtggaaccggacaggcaaggtgagaagaaaggtgtgttctgg

SEQ ID NO: 9 - DNA, 20890 bp, Brassica napus
aattgttgtattttttaaatataattctcaaaaattctattttaagaaagttttcatttttacttaaaaatattgtagatttgaagttgtggtttagtaatttggataacaataatttttgttgatagatgaaaaacagaagaagatcacgattcgttcacacattcccaactcacattacactaacacctttgagtaaagtgagccattttattatattcatgcctaccaggctaccaatatctgtaaagctctcctcaaataaatagcaagcataagattttgattatatcccagtagaaaaactagactttatcttctaaataatcattaagcatgctaatgacttagttacaaagagggtagatcaaaagaaatggatttgatgaagctctgggaagcttagtaagagcattggtgattctctggtagttcttgttaacatttttgtcttctcggtgactctcaacttcaacatcaaccttgacagtttcaagacatttcaaatttcccaagaaatgcttctctgattcagctctctacgagttcctctataccctgaaacctttagcaccttcacttgacatgtcgataaacaacatacttcctcctccttattcttcctagcgacgcacacacaggcgtccccgcatctatctgtaactcggtgcacaagaccctgaaaagcaaaattcatgtaacaacaacaatcaaacgaattgtgtgtgtgtctatgtatcaaaacgaaactggtacctcctactttgatgacaagagtttctaggtttggagagttgttgagaagaagtggcaccacttgccatcctttttctttgtcactctcaaaagacagagtaaggagcttgtgaaagaccggcattgatttacagtataggtgaaacacctggagatttattactattatttatcacaaaccaaaaaaaaaatgcaataactaataacactaagactttgcacttcagattgacacaactagcagaaggaaagataacaaaactaacctcaagagacgtaggagacaagtcaaggactttgtttctataacgtggatgtactcgctttctaagtgaagctccgagaagcttcttcgttccaggacagtgcggatccagttgtccactcgagaagcgtcgtgagtgtgctcacagcgcaaagagaatcttttgatgattgaagagttggttaggagagctagtgttttgtcgacgaagtcagggaagccacgtggatcaccagttgcagttgcgtcgtcgctcagatcgaggctgtctacgagggaaagcagattcctccaccttttggacagaaccaatgtggaagctgcttgatttgtcggaagcaaggacaggactttgccaagaacctcatctgggagactgcttattgaatctcgttggggagacatatattaaggtttaagatcgaaccagaaacttgtcgattaaaggtcacaagttcagaacaatcgaagaaaggagcaaacgaacgaaggtaggtgaacttacaattagaaaggaaccgacgacgagggagcgaaacgcagcgtttgacgtggtatttctaattgtgtaatatttatttttaaaaaatgtgatttcttttaaaaaaagttttacaaaagttgataggtttcggggcataataattgggttaattgcagtgaggatgggagtaaaattgagtttgcaaaagtgaggcggtaaatttgtatggttctgcatagttgaaaataaataagtttatcatgtgtttataattgtttagttataaagtagcgactaaataaaataaaaatgatcattttataatatatagctataaaatagtaaaattagaatattatacttagaatataagatatattaatttgatataactagtaataaattatttgtataatgtttgtttattttgaaaattttggtttatcccactatataaaagaagctaaatttgagcttcataaggctatccacatgtgcacaaatattcaggaccaaccaaagtgccatgtcatctttgtgagcttgcaattttaaaaaaatttgtcacctacgtggcccgtatgacccatctctcccgagcctctcttcataccatattggtcgcagcccattacccatctcttgatacggttcgggttatatcgctgtcctctctgaaatatcaaaatcactaaccctaatcaccgttctcgatctctttgtcgattctcttcctcccccaaactcatcccgatctctttgtcgattctctttctctccccaactcatcccgcataacgtccccgatgagagtgctggtacttcaatgtgctctcataaagccttcaatgttttcttcaaccatgctgttgcctgttggtgatgttttcaatttaatatgcggagaggatgagatcgacttggggagaggaggttattgttcggaattgaaacccgaaaatggatttcacaatcgtaagctctcacttctttgggctcgcttcgtcttcttaaagaggctttatcggctgcgttgaggctgtatcgtccggtgccggagttcttcaaccccggcttgaagggcgacaagatacaacatgggacttttgtttcgcagtgatgtttttgatttacttggctgggaggatgagatcgactctgggagattttgtttcgagttcaaaccggagggattgactttgaaatcgtacgctcttagtatacataattatgggccaatacacacagattacgatacaaacacaaacacgaagctcagcattagagtttcagccccggagattcaacagcaactaaagtaagattccaaattcgtcctctgttcagcctccagtcaatttcttttacttttttaatctttgcctaatgttcattactgtgatcaaaaataactcgcttgcatatgtcttctttttcaggttgttacttggctttctatttcatgaagcacagaacgtagtatataaaaggaaacaggaatacactttgcaaatattctctgtgtctttggattaatctataatcttgtgatgtagatagatacaaaagcttcttacggatctccatggagaattcatgaaggtaacctgaaacaactctctatctcttgcaagtggatgccagactaatgtcatagtttggtaaaattccagattaagttttggtgaatgactttgtgttttgtacagaagataagaactcatgttcgttatgggaagcagttatcacaatacaaccttacttatcgaattttcatcaagtaatattacatgatttataattagttgtgtattttatgacattttataagtgtggttgacgataaaaatgacaaggctatcacaaaagatacctcaagttcaggtattttagatatgggactctctggacctttaatatgtgataatgtatcgaagttttaagtcttcttccaacaatactctaattcgattttgtggtgtatcgatacatttcctgaagggcttactcggaagcttccagttaccaacaagtatgtgaagccaatatgtataggatttggaggggcggaggaccacgaccttgaaaatctgaagaaacagcttgaagatgatgatctcatcagaggtacaataactgcggaacatcaaggcagtgaaggtacaattttacctgtgcatgtcaaaaccgaactctgtagccatctccctacaccggtttagtcataactgtcatttgattaacaaacagagtctggtgttaattagctgatacaaaagacaatcgcgcatacagctgagagggtcacgtggtctaagtcttgaattaacgtttgagttgttctgttcagtgacaaaggcttctgtccattccaaatcaagcaggtacacatatgaatccggtcctgtgtttagaatcaagaaacaaagttccttcgcgtcaaaggcttgtgtgcgagtctcttcagtgctctctttggctttcttatgttcgattcacacaagtattggtcttccacaacaaagactcatccacattattacatcttctgctataaaccttttcttttacctctaggctcattgtcaataccaaaatacagctgcgttttgaccttgattaggtgtgattgtgactctctttcacttcctcgatgcacatggctacacttttctttgcggtggttgagatgtcgatagacataatcactcttgggaaaatcaagggactgctcagcatgggtcgcctcttttgcttgaaatattggagaccaatgagttagagtttagagacatcaattggtagattcatacaatataagcttagagttttgtttcttctttgtttttccggttgattggttttaagaaatggaatcctttctctcaaaagactataagcatatttagtgtcagatggcttgatgattcttcgattttgaaaccagaaatctattttcctgccaaatgcttctttgttattgttacatagtggagtgtttaaaacattactaaaccaattccgtcaaattttaatagaacgaagcaaaacgattagaaccagttgtatttttatatctttgtaaaactcagcttctcaggatcaatcttatcactacgaatcatcattctataaaagaagatgaagtcggatttggaaagcgtttggtaatttttagaagtttgagagaaggtaatagaagttgtattaaatagtggatatagtggacgtttgaattaagtttgtacacttctcggattgatacatttattcacgttttgaaattgaacacgtctattcattaaacacgttcccaaagtcttagaaacaaatacattatcaattcaaatcccattagaataagttattgttcatacgttctaaatatttaataataaattaaacaacaaattttttatatctacaaaattttcatcataacataagtatttttatcacgtaaattaaattgaaatgcatttgaaatatttagtaagaattaaatatccagttttttaatatcacaaaaaaatatcttttatcacgtaaaaacttgaaaacatccatgtataaaattatatacaatctgtatagagatttatctcttttgaaaaaatattaaaaattatatgatgtaaaatatattttaatgataacacaatacaaactatatataatgataattatcaaatcaataaaattcatttctaatttatggttaagtatatattaacaaatttaattatttattaaagttaataaagactttgtaacacagtataatttagttttggacaatgataattatcaaattaatattttaaaaattttatggttacttatatattaacaaatctaattattcattaagaataataaatattttagccgctctacattttaaagtgaaagtttagaagatgaaaaaactcactccataaataatattataaattatttaaaataaacataaataaatgattaaatataagtttgattataacaaacaatccgcgcagggcgcggataaaagatctagtaattagtaataagttatttgtataacatgaaattgagtatttgaaacaaatatttatgttttagatatttatatttattaactacataaatatgtattccaaatactcaatttcatacttaaatatgtatgttaaatgcccagttagatgtaaatacacattttcccttatgtgttgcttttttttttaacttatgctatatccgcaatggccgtatatatttttcaaagttttgctaattagtaaaacttttgaaatataaataaattttaagataataatttaaattaaagtaatatatatatcgaattttaatttattatattaaagtttttggtttaaatttccagcgtttaatttttttttggtaaagtaacagttaaaacccattaatggaaagtattttcaccgcctttgagatcttttcctcagtattaatttccctagacgaagcaattccaaaaccaaaaacataataacacatattcattgcttttaccaaaaaaaaaaacacatattcattgcatgctttaattaccagaaaacgaataaaaatctcatttacgttccaaaaacaaagtacacacaaaaagaacttctagaagaaaaaacgtataaacacgtgtctctatacagagtgagaacaggacaaacaaagctggacagggttttaagtaccgtataaaccctcgactacgaacacaaaacagtttcaaaagtaagggtaatattgtcatttagttagccttcaaataatgttgccccggggatcatggacgctttatattcagcttacacatatttatctaactgaatcactcaagaaaataaatcacacagacgttttttaaggagagaaacaaacctctctctctctctcagatcggagaaaagagccatggcggctgcgtggaacgggagtgagtatttcgacatcgacgttgagaccggtagacaatcgttcgcgcggccgtcgaacgccgagactgtcgagcaagacgaagaagatctgagatgggcagccgtaggaaggttaccgtcgcagagacaagggagccatctatcggttctgcgtcggtcgcaaacgtcgcaggcgcagacttctggctacgcagacgggaacgtcgtgcagaccattgacgttaggaagcttgatcggtctgatcgtgagatggttgttcgtcaggcactcgccactagcgatcaggataattacaagctcctctccgccattaaagaacgtctcgataggtttgtttctatttttataggtttgttttgattattgatattcgatggatctttgatataatcttggtgttgttttatttgtagagttggaatggaagttcccaagattgaagtccggtttgagcatttgaatgttgaagctgatgttcaagctggtacaagagctttacctactttggttaacgtatctcgtgatttcattgaggtttgtctcctctttttttgactatcttgttccacacgtaaccttttgtttctaatattgtatctctttgtttgtgttgttgcagcgtctcttaagcagcttgaggataatgaagactagaaaacacaagctaacaatcttgaaagatatcagtgggattatcaaaccaggaaggtgaatgaaatacaatgttttgattattataactatgtaacacaaacactaacagtttatatattttgctgttcttgaaggatgactttgctactaggaccacccggttcggggaagtcgactttacttcttgctctcgcagggaagcttgataaaagtttgaaggttagttaattaacccgtgaaattatctaatatgctcatatatatatcacatgtttgatatctcttttgttagtattcacatgtatcttgagattcatctttttatttgttataaatttatttttatttttacagaaaacgggtaacatcacttacaatggagagaatcttgatgagttccatgttaaaaggacttcagcatatattagtcaaacagataatcacattgctgaactcactgttcgtgagacacttgattttgctgcgagatgtcagggtgcaagcgaaggatttgcaggttagtatttacactttactatattaacttctgaaattgacgtgtcctcaagtgtttcttgtttacattataggttacatgaaagatctaacccgattagagaaagagaggggtatacatccttcttctgaaattgatgctttcatgaaggtcagcatcatatacctcctaacttccttttactagtttataatttataagccacaatcaccaacactttcttcaaatttgttataggctgcttctgtcagtggtagtaagcatagcgtttccacggattatgtgcttagagtgcttggtcttgatgtatgttcagatacaatggttggtaatgatatgatgagaggtgtttcaggaggtcaaaggaaaagagtgacaacaggtctctttcactctctttaaacctctctattttcacttatccattagtctaacttataaatcttgatgcaggggagatgactgttggtccaagaaagactttgtttatggatgaaatatctactggtcttgatagctcaacaactttccagattgtgaaatgtgttagaaactttgtccatctaatggatggaactgttcttatggcacttcttcagcctgcaccagaaacatttgatctttttgacgatttgattcttctatcagaaggttacatggtttatcaaggtcctcgagaagatgtggtgggatttttcgagtctctaggattccgtctcccaccacgtaaaggtgttgcagattttctccaagaggtatcatacatcctaatccttttctttggttatattcatgacaagatctgagtttttggaaattataaacatttttaaataaatttaataaaaaagaaatatatattttttaatttgagaacctatactatgtaaaaaacttcctaaaactttggaggccaaggcctggttatattgttacatggtagtccaaaaatatattcttatgttttataatgttgttatgcatgcaggtgacgtccaaaaaggatcaagctcagtactgggcagatccttctaagccttaccagttcattcctgtctcggacatagcagctgctttccgcaactcgaattacgggcatgctgcagattcaaaactggcaacaccatttaataagtcatctgcggatccttcagctttgtgccgaacacagtttgccatatcaggatgggagaaccttaaagtttgcttcgaacgagagatactattgatcaaccgtcacaggtttctttacacgtttaggacatgtcaggtattataataactctacgtattttgattttcattacatctatttgttgcataacttctatgtttctgacatggaacatcttgtatgaaggttgcatttgtgggatttgttacagccacggtgtttttgagaactagattacacccaacaaacgaagcatatggaaacgagtatctgtcttgtcttttctttggcctagtacacatgatgttcaatggtttctctgaactgcctctcatgatatcgcgtctcccagttttctacaagcaaagggataactcgtttcatccagcttggtcctggtctattgctagctggatcttgcgtgtgccttactctatccttgaagctgttgtctggacttgtgtcgtatactatagtgtgggacttgctccctcagcaggcaggttggtcatttttctagacatccttctttttattttatggtttcaatgtcagaaaataaaaaaaatctttttgttcttttaggtttttccgatacatgttactcctcttctcggtgcatcaaatggctctaggtttgtttcgtatgctggcttctgtagcaagggacatggtcattgctaatacattcggatctgcatcaatcttggcagtgttcttgcttggaggattcgttattccaaaaggttggttattactactttacttcatacataataagaattgctatactaaaaccctcgcattttttgacagatgatattaaaccctggtggacttggggcttttggatatcacctttatcatatgggcaacgtgccattgcggtcaatgaattcacagccacgaggtggatgcaggtgtgctcaataatctcatatctaagttaatataatacttaagagtatatacaaatgcttaacaatagactttttcttgcacatcaagcagccatcagctatatcgaatactacaattggattcaactttctcaagctacgaagtttcccaacaaatgacaactggtattggattggagttggtgtactcatttgttatgcacttctcttcaacaacattgtcactctcgccttggcttaccttaaccgtgagattctttctattattatctaatgatcatttcttgtatatatatcactgtagcaatatattgtgaagctttttgtctttttttcttactcttgcagctctaaaaaaggctcgagcagttgttttagaagatctcaatgaagaaacccaaactgcttcagtatcaaatgcaagacaaggtagaagtgagaagaaaggaatgattcttccgttcaaaccattaacaatgactttccacaacgttaactattatgttgacatgccaaaggttacattcacttcctttgtatataacagtcctaatatatggttacataattatattttttttggaatgtcaggaaatgcgttctcaaggtgtaccagagactagactacaactgttatcaaacgtgagtggagtcttctcccctggcgttcttacagctttggttggatcaagtggtgctggaaaaactacattgatggatgttcttgcgggtcgaaagacgggtggatataccgagggagatatcagaatctctggttaccaaaaagaacaacaaacatttgctagaatctctggatacgttgagcaaaacgatatacattctcctcaagtcacagttgaagagtccctttggttctctgctaggcttcgtcttcctaaagatatcagcaaagaaaagaaaaaggtaagtatgaaaaaagattaactcattttgttcctatttaaacagttttactagtaatatgtttttgtgtgtttgttaggaatttgtggaggaagttatgagactagtggagcttgatagtctaagatatgcattagtaggtttacctggtacaacaggactgtctacagaacaaaggaaacgtctaacaatagcggttgagttagttgcaaatccatcgataattttcatggatgaaccaacatctggacttgatgcaagagcagctgcaattgttatgagaactgttaggaacactgttgacactggtagaacagtggtttgcaccattcatcaacctagtattgacattttcgaggcttttgacgaggtttgccctaagatttcttgggttacaagaaatattatcaaccggtgatcttaacgtgtgttcttttttgcctacagctgcttctaatgaaacgaggaggacaggttatatatggcgggaaattaggtgaacactcgcaggttatggtagactactttcaggtactttgtcttggccttctctacatagttgcttgtcacccaagaaaactattatttcaaaccctaaactttctacagggtattaatggagtccctggaatctcaagtggctacaacccagcaacatggatgcttgaagtaaccacacctgctttggaggagaaatatagcatggactttgcagatttatacaaaaaatctgaacagtttaggtaactatcacattacctacattttccaatctcttttaaaaattattataataaactgatctttaaccatttacagagaagtggaggcaaacatcaagcaactcagtgttccaccagaaggctcagagccaataaagttcgactcaatatattcacaaaaccaactctctcagtttctactctgcctctggaaacagaaccttgtctactggagaagtccagaatacaatcttgtgagactgatcttcacaacggtcgctgctattatactcggcacggtcttctgggacattggtaccaagagaacttccacacaagatttggtcactataatgggagctctttactcggcttgcttgtttcttggagttagtaatgcttcatcagtacaaccgatcgtttcgatcgaaagaacggttttctatagagagaaagcggcgggaatgtatggtccaatcccatatgcagcagctcaagggcttgtggagataccttacattctcacccaaaccattctctatggtgtcatcacatacttcaccattggttttgaaagaacgttgagtaagtttgttctctacttggtgttcatgttcctcactttcacctacttcaccttctacggcatgatggcggttggtctcaccccgaatcagcacttagctgctgtgatctcctctgcgttttactctctatggaatctcctatctggtttcctcgtccaaaaacctgtaagtatattccactctatcaagtgaaaatgtagttaagatggagaaatgagtgatcagttgtgtataatgttgttgttgtttcagttgattccagtgtggtggatatggttctattacatatgtccagtggcgtggacacttcaaggagtgatcctctcacagcttggtgacgtggagagcatcatcaaggagccaatgttccatggcacggtcaagcagtttattgaacagtactttgggtttaagccagatatgataggtgtatcggctgcagttcttgtcggattttgcgctctcttcttctctggattcgcactttcagtcaaattcctcaatttccagagaagatagaagacaagaacaaaggatattttgactctttcttatgttagcatcactcacgtgacaaacttttcatgtttttggctctttctcacattttagttagctttcttttctattttaccactgatttagagttagttttgttgacattgacgtaaaataaacctaaatatatatataaagaaactgtttttctctgtttagaaatttctttgcttttgtaattttttgtttagttgttaaaagccttgtctcaaatactatatgagaaacggctaaaaagaatctctgtcatcttacttactccacacgaaattgtttatatacaagtttaaccgatatgctaaacctagatacacaattttataataaaggaatgtagatatgttactctatgattcttacatgagtctccctaataatactatgtttattatgccttgctttctttgtttatctctgctcttagaacaaacaaccttgatttgttgggtctcctttagagggacgtcgttgttttttttggccaaggagacttttttttttgaactaccggctcaaggagacttaacacagctaacagagtgtctatgaatagcaatgagtgtaaagtgatgtctttgcaaatggtagcctcaagagccctagcatctccaatgggacacaaaaatttactctatatttcactctaaaatagagtaactctattatagagttgaatttgcttcaatagttcactctataatagagtaactctattatagagtgaaatatagagtatttttgtttttttactctatatttggagtaaaaaagcaacaatactctatatttcactctattatagagtaactctattatagaataaaccattggagcaaattcaactctataatagagttactctattttaaagtgaaatatagagtaaatttttgtgtcccattggagatgctctaagtggtagcctcatttgagaatagaatatgctgtcttggtgtttccactttgttaatatctcttgtggaggttttgaatatacaaatgtcagagctgttactcttattttatttttaatttattttatcattttgttgtattgagcgaccaacctataagagtacgattatgatttggagtctgacactcgttttctctcttgcatcaaataaaactaggaatacaaatttgaaaatactgtattgaaagaaccaaaatctctattaaaatccaacataggacgaatgaaaattttctaaaattatgtaggaacagttttacgagcaacactaatagtaatatctttattattatttggtcaaatgatacatactaaagggtcaatttgtaattaaaaaaaaagaaactaaaaagaacttcaaaatctttttagatatatttttagattgtgcaaaaaaaatatattttttttagatatatcacagtcatgcgcatcagaaaggcttatatatatttgggccgtaaagtattgtccatcacttaaaaaagcgacaactccgtgacattattgttgtgctgggacccaaaaacggcgtgcattttgtcgactctctcagtcgaactttttcttttgtccccaccaacaaaaagtttttaagacctttatttattgtaactaaaaacataaagaaaacgaacaaaaacttgatttgtaatgtaaatacatttaattaaaaaaagtttcacgagtacatttaacttaaaaacaaccagaaataagtaaaaaccaaaggactgttttattcctaaatagagctaggaagaaaggttagttgattttggatttgtcagaagcataaacgtagagatctggatctgtctcgtagaagacaatatcaccagtgtcactgacgtaatgatctttcttaatacttgccaccaaactttccaccaagtggatcggtattgctcctgacgtctttggttctctgtagtatcttcccaacacatgtttagctgatttcgtctgtcgcatatcattaattaagatcactaatttagtaattaatcaccctttaattttaatcaaatgaaactagagagagagcgagatcactcacggcatcaaccaagtgatagtgagggatttgtgggaaaagatgatggatcacgtgagttccaatatcgtgatgaatgttgttgaagatcccgtaatctctatcaatagttgttaatcctccacgtaaataactccattcctattattgtacacaaaacatcaataatttagattaatcaaatactaatcattgttgcttcttataaattaatgttgatctacttaccttgcctctgtaccaaggcaacttatcatcgtgaccatgatgatgcaagtacgtgacagcgtccaaccacattacaaagatctgaaatttttccaaaactttatgtcaaaaacaaattatattagcaatgatataataatgaaatatatgaaacttacaatgtaaggaacaccatagacttttagaactgtgactggaccaacgaggaatgatagataaacaagagtggccaacatgatcgaccagcaagtagttgaagttgcaataagctttctctcgcttggggcaaataaactactgtatgggttataatgtgacccttctttaccaggacttctgtaccactgtagtcatccccaaacaaatttaatttatatttagttaatactcaaaatctaaaaattcaaaattgtaattataatcaggaagaaaaatgaggaattaggatttaccagatagagagggtaagcgagcatggggagagggacagtgtatctgagcatccgtgtactgtgggacaaattcttgtataatttttctggcaactggaatgcaaaattaagattaaaatgttaattaatatttaacagtatggttatatattcgaatttattcattgcatgtggtgtgtttataagtttttttctttttattagttctacgtaaactacaaaactgaaaaatactaagaaaagtaaacgaatttcgagaagaatcattttatgccaatggctcgaatataagtggcccgttgttaaagttaactacagtaccataaacaatttaaatcagttgtttactacagctaaacgacaaatctgacaagtggtcgtccaagcctcacactggaaaaaggattgattaaaataaatacatagaattctaagaaaattaaaatgaaagagtttcaaaaaaagaaaaaaaaataatgagagggggattaccggaacccaagactcgtcgttttcaacatggccatggttctggtggtgtgtccgatggcttattctcctgcaaccacccccaattataaaataaactattattttattttcataaaaatgaaattggaattgtcaataacatatcgttttcgaggcagatgctaagaatctcactcgtttaactacgttattcattttttgagcaacaaacaaatgtatctaggaaaatgatgcatgttcgtagatatttcaagctgatgtatccatttaacaataaaataagccattaaaacaaatatatataaatattatattaaacttatacattaatttattcaaggacatgtcatatgataatagctaattggaccataaataggcccatagcattaaataaaagtttggttcttttttcttcgatgctaaagattttgatgcttttagtcacatgcattattttactatgaaaaattaatatattttcagttatcagattactgtttgctaacatgcaccaagaatgacaaggaaaatgtaagaaatacgaaaacaagaataaatttgcatgaaaaaagaagttaaaataaatgacttaccaaccatggtatggaacgagaatgaaggaatgaagaatatgaccaaccgcagtattcagaagaggaatgtctgagaagctcccatgtccactgtattattcaaatgaaattttacatcataaacacatttatcatttattgcacaatgttaactgaactttcctcaattcaaacgtttcaacaaggtaacaaaaatagaatatgacgtgtcacatgactatatttcgaaaatagattggaacaacacacaataattaaaagaaccaataaacagtaattaaattgttacagaaaacaataaaatgtgttttattgaaaatttcaaacgtagatccataaaacgcggaaacaacaataattataggaaagaaaaagatgtttagttaggagtgttacgactgatgaaaaagaaccaaaaaaaaacaaaagaattaaaaatcttagatccccttttgcttttaaaataggccaaattggatgaacataataattaaaattgaaaaaagtaaacctgaagagaatcaaatcttgaagtcagtgaaaatctcatatcgaacgtacggtcaagaaatcaaagacaatgcaaaaaacgaaaaaaacatataaacatatcaaaattaagaagttgaaagaaaaattaaattaccagtcgtggccgagtacgaagatagcccagaacagggttccttgggcggcccaataaagaggccaaaagaaccagctatcaaaatacacggcggcgacggcaagagccacgacggcgaaaatgtctctggcgacatagctcatggatctcaaaggactctttacccaacaatgcttaggaatggccgcccttatatctccgatcttgaacggtggttgtgcgctcggatcaaacctttcgtctccgttcgcattgctacgctggtccatagcgacaaccatcgccggagaaagagagagagctttgagggatgtttctctctctctctaaaactgtgtgggctctgagtgaaatgtggtgaagaaagggtctgatggactttggggtatgtgtggtttgtttatatagagggagaagatgtgtagagacaccaaactgttttctatttttcttaatttaagaaacttatttatttctttgaagaataaaaagtgtatttttgcggtaacctgtgcgcaatgtatctttgttacgtcgttcatttcgatgaaaactaagttagagaaatgtgttacaaaaaaaaaggcaatgctataaaatttccagaagattagaaattgcgttattaagtataaggattataccaaattgcattattttccttagaaataaggattataccaaatgaattgttaatgtttcgtacttttactggatatttatgcactgaaatggtagtcctttttgggacttaaacaacttgtatgatttttacaatttagcaaaagaaaaatacatgtagtcgaaaatattttttttagtcttcaatatatagttttttgctaaaatttcctcgattatgtattaatcataaaaaacgatctatatcgatatcatatagacagtagatatgacaacatttatatggatttaaaaaaacgtattaatgtgagggaaaatagttgccacatcactgtgatgtatttgacttaagaaacagacttccatcagtttatttatttgagacgacttgattaaattggcagtctatacaatagtacaatgtataggtaactttaattttatcaaaaaatttgtgtaaccaatcaaatttaatattagttatattttatagttggttgaataatttttaatttataattttaataatatattttagataaaaaatattttttaataaacgtgttttatctatagaatatcttatatttagaaacggagagagtataacatatgtatatgagaatcagttggatttaacaaattcactagatccggaaataacaccaccaaaatagaacaagatcaaaacatgatgtagggtctgaatgaattgcttaaaaatggtataatattccaattatgtttattagtacttataaaattagtgatcggtttaactttttaacatataactaactttgactgctgaatatggtgtcttgatcaaaaaagacatttgtggttagtcaatgagacatcatattttagaaatgcaggcaagatggcgtttcctctacctctttttctctcttaaatcaatttcccaacacgtctttacgagttaagcatcaactaattgctacaattgtatacagatttgacctacttgcctccattaactacatttcaggctatatgttagtgtatatgtaggcattaattataaatacgcatttcaactgagcttcaatgcatatattcaaattttttgttggaatgatttccccatctttaagaatcgggtagtgaagactgaggacgtgaaccgtgggtttactgttttattaactctacctatatcagtttttaatattcaattttatatgagaaatcgattaatattactataatacaaacattgttttcctccgttatattatggtttttgtcactgaatttgaacatgatttgagacagagaccaaacaatatatgacgtctgtatacttaatcaaaatatgagaagattatatgcactctatctttaaacgtgagatctccaaaactgtcataaaaacgtgaactcgtttcttcttccaataacaaatatcaatattgttcatccaattccttcctccataaaaacgtgaacacctttcttcttccaatcgtaatatcatgtgttgttcatccagttccttcctccacaagctttctatcgaacggaacagtctgaaaccgtgttaaacaaatcaccctggaagatgtaatccagcttctgtgagagttttgaagaaggaagatctctttttgtaacgcaaacatttaattttcctcatatgtgattcgatgatgtttgataattaaaaatgtgatggccttaatgaataatcttggtcatgtttttagtaaccactatttcttctagcagtcatcaaaacaatttttttttataatgttgatttattatgatattaattatgaaaaatattacatagacgattcgacaaccgacaatactacatgtcttatgaggatctacttctaactgtattatctgagccgtcctacgaatatccactcctgactagatttacttgcaccatgttgaagattccttgtaagtttttcttctgtagtctgcattaataaatcgttatattcggaacttgaaacatggatttcctgtaatctgcaaataattgcatagtctgggactcgaactccaaacctgactgtataagtctttaaaccttaactaataggctatggtgcttccacgatcatcaaaacagtttaccacatgagattatatatgacgttggataacatgtatgattaatttattaaagactcattaataaaaatttaactgtagttttttttttgaataaacatagtttcctcgatctcaaagaatctacaatttaaaattcaaatgtttctctaaaaaatgaagtaattccacaatataattgagtttactcaaatcgtaattcattgttagagtgaaaataaagtaataaataaaaaatacttttttatttgaaatgccattttaaagtaaattacgaagttggatggaaaatattttaattactcaaaattttataactatatatctaggtgagccatggaaaaggaaaggtacaaaatgatgagtgtgggcgtagacatgaagcctgcacgtgagagttgtagctattcgacaaacatatactaatttgttgcgtaccatttccactttatatatatttatatatttgtgtgtgttgagctgagatatgagaataaaaattgagaatatacctcaaaaatgcaaagagaagtatgtgtttgttatttagcagacgcacatggtggaggacatcctcgtgagttccgaagggctaagttatacagctttaaccgagctaattaattcatcgtccttacataatttgagcactatttgaagaagacagagtatatatacatattagttaatacagttatatatgatccaattttctttgtttgacaacaatgtgttttcaaacaaagaccctgtaactttttttgacccggttctgatatatgtatgtgaatatgtgattcatatatttctctaactacgagtacgactaaatgtgcttatcaattatcatacacgtctctacgtgcttctctatcttatattcttggtattaaccattcgtattttatgaacattcgtgtacgttgaaaggaatcattacgtagatgcccacgatgttacccaagttggagaattatgttatttagaaaacccatttttaattacgctaattaccaaaaataatatgaagaatggggccgtgggaatatgctttcggtaggttttgcgttctaaatttacatagcataggcagtcaacagataagaggttaaatgtatattagaccgaaatatttttaacgtgttggggggtgggggggg

SEQ ID NO: 10 - DNA, 105998 bp, Brassica napus
acaactaatactatatctattcaacaaaaaaaaaaaaactacccaataaaaaacatttcaattgcaataatgaagataatgatatgacttcagaacaacatcgtcccatcttaaacccaatatgatgtcatctttagatgataaaatattttgatttttatttttagccttttattagaaagaaaattaactgtaataaattatacaaattgaaaaatatccttacaattttattaagcttcaatcagacattaaattttttgtggttacaaatttttgcagattatttcaaggaacatgcaaaatattcatcaactaataaattatttaaacaaacatattaactcatctattatattaaattaggaacatgatctattaatatatgttttgtgctactattttgatataattattaaaacattttactaatcacttaaaaaaatattttacaaaaatataattataaaaaaacaccaatacgattaaacacacaaatagaaaaattagtttaaaaaatgtaaaacagaaaatatacccgctctttgaagagcgggtcagaatctagttcagtgataaattagaatatgttacttttgacgttaaaacaaacagaatattttttgaacactagaatatttgaatatgttaattggtattgatgtttttttgaaaaaataaaaaaaataaaaattaactctgtgcttttctacagtaatagaatcgatgcctcgagtcgagatacaaccatctggtgcactaaaacttgggaccattaagataagaaccaagcaaattgcatattacattatatatatatataaatatatatatatatatgtatataaaaattacacagaagttgtcactattaattaaagatatctttgtcaatattttaatggtgacatcaataattctttttttgggttcttcatccagctgccagtattcaaaaaaaaaaatctctgaaaatatttcattgattagaaagaaatatacatcagcaaaattagcatatcaacaaaagaataatcaaggctaatggaacataacatcaaaacaaagaactagctaaaacagaggaggatctctcattgtcaaaaagataagagtgcccagaaggatggctgagagcaacataagatcgcattcggttttgaaaaatcacatgttgaacgatgagatgagcttctctgttagcagtatgatgttcgcatacaaccttccattgatccaaattttccaaaaggagattaagctccaccactttgaagctaaaggatgaccacgctcttggtctattaattgcacccactaaggttcttcccatctaagtcaaaccaaaccttcaaaagcttatgactaaatactttcaatatatagtccacacaggagagatgaaatgagcttcattttccgaacccacggacctgaaagcccctcggctatgcatagacaagtcaagatattatcggcatcatgccatcttttgcataccacacgtcggcaacaaaatatttccaaataaacatatttaagcacaataattacatctttttggttaataacgagaatctgttgatagtatggttgaattagaataaatcttgcttttcttcttacattttctcaccaaaattcaacatgcacgcataaagtgtgtaaactgtttagtataaaatttcacgcgaagttcgtgtgaaattggaaaacagacctaactctgtcttaattcttgcaaatgcagcttgattttgaagctaaatcctttaacttgtggttaacgttgattaccaaaaaaaacatgtggttaacgtgtaaattaacaacccatttagtggtgaacctaactcagccatgtcgctttataattaggtcaatattaattacagaacttcaattcacttggttcacttacctttgattttccttgttccacgactctttttttttgttttttttttcatacaagaaactcagatggcacatttttaaagaagagttgaaaggaaaatgaacaagcataaatttggtttttttcaaccgaagaacattataagtcaagttttgaattatcattaacatgtttcttattatggaatagccatacacattcggagttcggtcatatgtatcatacatgcgtgggaacaagaatattcgtagacaactaattttaaaaatgtgacgtaaatgtcaaactattagggtatgaatggtgaccaaggaatgacgaggaacaaatgcattccctaacattccttacaaaaatcaccattcataaggaataatttttccttctcattccctaccattcctttttatgtagagaaataaagaacaaattaattccttgttaaatatgagatggaacaaccattccctttcattcctgcaattttattcctctacattcctttcctattcgttcctcttgtttccagaatggttaccagtcggacccttagaaaaaatcttacgatattttttattgaaagatgacgtttcttttttctggagcatgaatattcatatatctataggactcctgttgacaattaaaaactatcttaggccggggtattttgatcggatttaagtctatgtatttttatttataccaatgggccgggttaccgtttaagtttaggacaatttattaaaaataatccaaaatttgaaaaatgaaaatctatacatgaaattcaatcaaaagtaaaattaatctaaaataatagtgcaattacaactatttttatgactaaaaatatataaagacttttaaaattatagtcttgaaaattttgcacgggacaatgaaatcttctgagaagtctagttataaatctaattataattactttataaatttttgagaaaaaaatactttgattggaaataaattgaaatcatgtgaatataaaaaattctaaataatgtaaattgaaagttaataagaataaataattatgatacatataagtgaatatatattgtaagtcattattgtccattggttagaatttttgttacatattcaagtaatatttatatagttatattttggattcttaaatattttttgaaattaaaattttgcatataagtgttaaattttgtgtatattaaacattttacaaattgattttattttaataaagaggtatttctagttatttcaattatttgattttaggctctaaggataagagacttcgtaaagaattcggctaagttattttgtttcctatccgttttgattttttaaatctctttgttgtgaaatctgttattaaatatagcataatttaaaaataattgtaaatataaaacaagtaacaagtatgaaaaaattgctacctggctatatattactcgaagacattattattgctatgaaaagtaaataatattcatatatagaaacatccatgtttttgctcattattatcttctgtaatgtgcacaaatattacttttagagtgattcctgtactcttatagtagagtaaacaaaaaaaatcatatttttttaatagtattatttaacaaataattttcaaaaactctatatacttctaaataactgacaagtatttacaaagcaagtaacagaacatgacataatgtacaagtaaatcattattaagcaagtgcttgaaataacaaatgattgtttttaacaaacaaaatacaaatcaaaattttgatgactcgtgtaaaacaagtcaaatatcaaatcaacacaataattaggtttggttttctccagagcatgacacctcagattttaaaatagatgtgggattgacatgtcatcaaatgaaaaaagttgagtaaccaatctaattattttgtacgtccacatcagtttcgctcagccgtaatgagaaaaaaaaattacgaagattactttacctatctcttctcctctgtctctcctcttgctctgtttcctcctctccttactcaatttttttcagacgtgggctggtcaaaccccaacccttgcaaatgggacaccgtccaatgagacgggaacagctgcgtcacgaggaaccagctcagacagaaggggatccgcagcactctccctccggatctccataaactctccgagcttgtcgtcctcgagactcacgtcagacggtcagagaagacagagcagcggcgtcggagaagacagagcagcggggtcggagccgagctcgtcgtcctcgagactcacgagtcagacgtcggagaaaacagagcagcggggtcggagccgagctcgtcgtcctcgagactcatcagacagacgtcggagaagacagtgcagcggcgtcggcgaagaaaaagagcagtggcgtggtcggcgaagaagagcagcagcgtcggagatggtactgaagcggggctgattgacggcgtaggttgaagaagagctttgtttgacagctgaattaggtttaatcaattggtttagttaataaaccaatttgtaattgtaaccaatttttaattgtaaaccatgtatccaaatttcgtatcgtaaagaaataccaatttataatccgatttagttacaaataaacttttattttatgttttttttaaaataattaaaagaagtaaatactataaaattaataattttaaaataaataataacaaaaaaaatgatattaaataatatttaatggcagacaaaaaagagaattacactatgatatcactaaaaaaagtttctgtcacaaataaaaaatatagactctaaagattgaaatgatcaaaatgtttcattaaagagttaaatatacatttatatctctagggttaactaattcaaattttagagtttaaagttaaaagtggagatttgagattgagatttaaaattttataaaacaaaaaataaatattaaaaataaaaaatttaaaaatagtttcaaaaattattttcgaattacaaaaagaaaatttcaaaaaaaaattaataaaaaaattcgaatttgaaaacatataatctaaaactataacaaaatttttttttaaatttttttaatttattttaattttattttttatatatctatggtgttagggtccttttacctattaaataaaatattttggtcattttcttccttgtggtctatttttgtgaccaaaaattgaaaatgatctttttagaagaattgctctacaaaaaatgctatattaatcataaaaaattaatcataaaaagtaatgcttatcattataggataaatttttataatatctattagtgtgtatgctttttgaaattgtttaagcaaatttgatacactatcaagagctgcagaaattacattatcaaattagattaatactaattctgtaaaaatacaaaatttatataatatctttgtccgcggcgtagcgcgggtattaacctagtataagtaaaatagcaaatatcaggtctgtgtgtgttcccatattagatggttggtccatctgactttgaaaggtactggatttgattttgatacccagatggcgatgttttaaaataattgaattattaatctagttcctaataattaatatacgaaattttgttattcagctaataattaatcaagtttctggaagattttctttcgggaagattgcacataatgactttcactattaaaaactcgtttcatagctagaacattttttatatattttgtacttttattcatggctgatttacaacatgttttctatatattttgaaaactaacttttatagcaaattactaactagtttattatttctttttccaaatatattgagaaaatttgatcaaaatgtaaactagttttccagaatcatatataacatcggaaatatatcagaatatatatagtgttacaaatttaattataaattttcaaaaactaattagtctttctatgggaatagaaaaacagacaagtcccaaaggtttttttttttgacaaagggttaagtcccaaagttacgatgataaataatgttacaaatgtgtcaccaaatttgtgagaaacattgctaaggcatcagcagtctaccaattatcaaacgcatgaaaactattctcatgatcttaaaaatggcgaacaaaatgaactcaacaagattttgattgtggcctgaaacgatcagcttttatgatactcttataatatcacaagattttgattgtgggtgatcgtactgatctaatattagttttatcaagtttgcagaacttttcttatcgatttcgctattgagtttacacttacctgctgtatagtattcacatcgccgagaaggtaaataaacagtactcttatgtttttttgtttttttggtaaaatcagtactctatgttgcaaaaatgtgcgactgattcatgtttggctttacatttttgcttcggtagaaatcagaaagcaagtgaatagtaaaaaatggttcgtatcaagttggtgtaaaattttgtgattgattgaacaatttaattctgtcgagttcacattgctgctagcctggtacaaactctccaataatttaaagaaacgtaaatggactggacatatgcatgcacacggttgggaattatttaagaaaatgtaactcaacaaccaaatcttgtaagtgtcctgtcatttggtggggtccatccgtaccatctcttaaaataaaactcaaagtacatgcatgtaaaagtggatcggaataattgcactcccaaaacaaacaaaggctactagaaaatatatgcaaaaataaaagaacagaaagaagaaaaagtgagattgcgtgtgtaaaaagtaaagtagccagaaaaaaaagaagaaaaaagtacaaaagcgtccctttgatagatgtattgtgttcaaagttctgtatgatgtttctatgaaatttctagatttgataccataatcaatatactcggatccgatagacctcataggaaggttctctgaacactttaacaactagtataagaaatagagttcaatacaaaatattaaattacaaataaggtttattgtttagtttcgttttagacattcgtatctaattataatttatagtctttggtagattgatcaggttaaaaggcctacatgtgacaaatcagcatcatgcattaatgggttcccaatttttgcgatccagtttagtaaaagtcagattaaagccaatgccactatcaccccaagaataccatcatgggtcctgtcaactaatgtgacacatgaccgaacctgaatcgttatttgtcccattgtaataattcacaatctagagggcttatccataccatatctaagccggtcttgtcgcttcattccatttttaccattttactgactaattataagagttctatctaccccctaattttttttttaaattgatcatttattaggccgattgtaacgttatgaacattccaacccggtccatcctgatctgatcagatagctaggtgtcggtcatatcacaactagtgcttggttgtggatcaaacccgacaacccacagattgagtgattttttttattcaagaaatttgacttgtttaacccgcaacaagaaaatataaaatctacatccgtccgcttaaacttgcggatgacccacaagtaattttaataataataaaattgttattttaaatattttttaaaataataacaaaaatcaatttataattaaaattaaatattttttattaataatattttcttcctaattttttgtggttcaatttcggctgacccgcataaaaaactcttgacccttacccgcatccgccaatcaactttttttcaaatcactcgaccgcaacaaccacgcggcggatccaacagggcagaacccgccaataatgactcaaatatctctagcccaatattgatcggatgatccggttttgaagttcttatagaactgcaatacactaatctaatgtaacacgccttgtttaataaaaaagacacaatccaatgcatacattttgaaaaatcaaaacaaagggatattctttccacataacgaatcccaaaacaaccccagaacctctcatatgtgtcacatgtgatactcttgtgacactaacatataaactcgacacgactcagaaagtgaacatgatgacactgacagaacatgtatcaatttcaagaaaaagaaaagaaagccaagttatgcgatggatttaaaacatatcaggctgtaaattaactagcctcgtgtgtttgttgtatcaatgcatgcatcttacgcagagggcacagactcgtcggttttcttttcttcaacagctttctctgcctctgctgatgctaccttctcgactggtttctcttccttcttctcctcggtgtccttctcttccactgtcaacttctcaagaagaccagcagtatcagaagcctctttactctcttctttctcttcttcagaatcggtaacttccttgaacttttgcataaatgctttgcagtctgataacggtattgtaaacaagacttgattatttatacaaggtagaaagatttttaaaaacacaaacaataaatcacatgaaacagtttccaatactacacgtctactacaccagctcattcccaagctacactgagacagccaatataaacactagagctttcgactgcttttagtctatccagatcatacacttgaacctacacaaatgtccagatacctctagttggattgccacctttaaaaggctaccattaagtaaacaaccatgatacccttcaacaattactgattagtgcaaagggaaaataactcaaaaacaagtaaaaactctaaaatgggtgatactataagcttgtagaactgaacatccaaaacttgtgaccatatgcaaatatcaccaagttcaagatcctccagtgacctaagccataaatttacattatctacactctagaccccggaaaaaaaggattagtcatgctcttaaggtttaagctactataagtatgccacacatacacaagggaaaaatccagactcactctcaactgacgcaaagtggattaaaaaaaggtttaagctttggggaacatcctaaagatttaagctactataaactatgctacaatgagaacagtgctaccacaagcaacaatgagatccaaacacacacaatgagactgattcgaactcactctcaaccgaagcaaaccggatacagaaaagctcatccttcaactccccatcggagaaatcacgagcgtgccacacacaagacttatcattcccagcgtgttcctgaacactcatccccgacgtaactgcacataaggagaagaatcaaacaatgagaataacacaaacacagatccatcattaaaaaatagtcacgatcggtaccgagatgattagcacagatcttgagagttttggactgcctcataacgagacggatcttcccagactccttatgcttcaagaacttgaccgtaccagcgcctctctccttccactgactcccatctttatcgaacctatacagcttcgatttcctaacagattcgcaaaaaaaaacaataatcaacaaccacgatcagatctagaaccgatctagtaggaggagtagagtttacagatcgaggattgcgtcttcgttttcttcgccggtagtgacggcgacttcttcgagtttgatgatgggagcgacctgagcgccggtgtcttcgtcctcgttggctccggactcttcttcgtctctgtgctcgcgctccggctcgttgctgatgctcgccatcttatcagatcagatcgaagctttgctggttgttgttgttggattacagagtgggcgtaggagctagctagattggaggagagaatgttgggagagtttctgttgacggaaaatgatttgtttttttataagagagagagacggcgctttgttggaaatggatctttgatttaaatgggcctacgtcacgtttattccggagagctgaatatggtggactgtactggatccattctggaaagctgagtatgcagagctcaaattgaattaatttgattagggggcatatgcatttgtcttttcaaatcggaatttgagttagttcttatcaaagaaagttcaagaaatctgtaagagatagttctgcgtttcttaagaaattattgattatgtaaattagaccgatttttttaatatttaaaccatttttttaggaaaaaatgtttcgtttaaatactgcttaggcggacgtccaactgttgcgaacataattttttagaaaactggttcttatcatatatgattttcagatagaaacgttttgaatacattccatggaatttccgattggttgtactcaggtttcaaatcagttccaattttttttatacatgtaaatatttgaaaaacatattagtcctttttcttggatactttgggaaattctttaaatttatcttgttacaattattttgttacaactagatcataaataaaaataatcatgagtatacggattttgggactgaatgtttcaaacaaaaaaaatttagattaatatttgttcacaaaatttcaaacacaagactaaacttgacattttttttcctaaccgaatccagttaaaccagtatgctaaagtcaaatatgacacaacaagaacatcatgtgtcgaaagattcaggtagtccagtttaaaactaagataatatatttcatgaagatagtgtttcaaaaggggaaaacaaaagaaaaagtcgctaggaaagttgaaaatgtccaaaatgttccaaacccaaattgagaaaaaaccacatccacattccctcagatagaccaccaaaccagcctgagaaaaacgattcttttgaaagaagactttaattcagtaaaggaaacagcgaaacatatcattccagaacggtgacttgttcccactctccatcaacagcctctttccacaccgtcacgttgttgttcccatcggacacggccaacatgttacctgtcaacgaccacgacacccgccacactggagtcataaagtccttcagaatcttaccttcccattgctcaccttctttccccacagtccatatgatcactttcccatcctgtgagccactggctatggtggacttagggagacccaagttcggtgcccaagccacatcacgaacccaatcagtatgcttctgaagagccggaaagcaatccatcttccacgacccgtttgagagcttccacactttcacagtattatcacacccaccggaagccagcttgtaaaccggatcaagcaagccagagctgacaagagcaccaggggaagtggcaggtgcccatgagacagaagtgactccaacaggatgcgcttggtcaatcttcgtcgtgtcccagccaccatcagcacggcctgtgaataccgaaatgtttccgtcggatgacccacaagccaaggatagtccgaggtcatgaggagcccaagcgatggagttgacagaagatttatggtccgtgaagacatgagcttgggtccactggttttggctgccttctttccagagtatgacctgaccgtcataggagcatgaagcaaggaatgatccaaacttagggtgggcccacgcgacctgccagacaggaccacggtggccggttaatgtagctaggtgctgggatccaccgttgttgctgactccggttatcttgatggtgcagtcagatgaggcagttgcaactctctttccgtagtagtccatttgcacatcatggaccatgtcttcatgacctgtttcgatcttctgacccggcatgtttccggattgactttctctgcttcttaaaagaaaacacagcgaaacagctcgtaaacacacagttcaatttcaatgaagtataataacattttacacgttgaggatgttcgcttaaccacgtgttctcataggctcacacatgtaatcaagaaagattatataatatgattatgaacagaatgaagtttcagtcagagaccactaacaatgtaccattcaatcctcagagatcaatttcaacctcaactaagaaaattacgattgatcaaacgtcacaggggccaattgcacaatactgtataagagattaacaatagatccgagtagtaaatcctcagaacgaaactctagccgcagatcgactcgattcaaacacaaagatctaagctaagatctcgaatccaaagcagaatcaaatcgattcaaatgttgagagatagctgtagaaatgagattcaattagacggatcacgaggtcagagtcacgatacaaaccagatcaaacgaagattaatcacgctgacaaaatcaatcacagattcgaacagaaacctagcttagatttaccgagacagcgcagaaaatcgagaaaacgaaattcgcagaagtagctcagggaagagatagcgtacctgaaggagcggtcggtcgactaagagacgccggagtgtgagttggagaagaagatcgacagagaagaaaacgctagggggaagcgatggatagtttttttctgtttctaaagaaaaagaaaaatagatctaacagagtgatctaaaccgtagtccagactctaaaccgggtgggtagactagagatattttattataaagcggttatcagcgcagcttaattatctaactattttcttctcgaccttggtttgacccttttttggttctagagtttgtataaaccgatctcaaaactaattacagagtaatctaaaccgtggccatccagattaaaccggacgttcaaatagatgagagtcaactcccatgttttttttctgaacctttttggctatttttttcttttcttttttttaatcatctgattatagatgaaatacagagctaacggaacatacgaagcccccgaatcaaaagcctaaaacaaggcagcatagagtttcatttctacggaatttctatagcataatgcgtttagtcaattgtttttttctttttttgctaaaagtagtcaattgttagtctcatttaacaaaaatcatatcttatattctcacggatctatattgtaactcttaagtatcatcaatgaatttgatctcttctacgttactttggttgatgtgcacttgcaatatagtagtattatataggttaatacgttgtcgtcaacttccactgtttaccatgttcttgttcatggaaacgcacaaaccattcgattcgcctttcggaaagtccccatataagtgattcctcgctgaatgatctcgttggggccaacctaaaagtgcattttgtttactccctagcagtcaaacatttcattcctgagttcaacaaaatccagtaaattcaatgttttaattgtttggcattcccgaagaattttcccaaattgtattatcattggacattggctctcttattaaatactactatgggtcaaaccttcattcaactacgaagctttctcacgtttacatgcttctttttttatatatggataacctacaaaagagtcgtaaaatgaaaagggttgctggactgcactaccctacccacctaggtattggctaagttggccaagtatacataatatgtaaatgtattaaacataaactacaatacaaatatgatcaactcgtaaagaaatcaaatatttaatatcgatgcaaaaatatataatattggaattttaagtacaattatccactaaaaagcaaagaaagtgttgcacaaaaataaaatagaaaatgaaaaaaggatatgcgatgaagagagtggaatactctaaaaggtagcgtataatctatgttgatacctttctccaaattgaaaacttgtggagttgtggcaatccaacattgcccaccacttcatagtcatattccatttgctcctccttatttctttgtttattgtctggtttttaaacattgatcaacgtttatagttcacagactatgcgacctaacaagtttatctacaccaacaccaaaattaaagagaggctggcaatttcaggttggcccctaatcacttactttagtaggcctaactacactacttgcatggtcttagttcgtctctaacgaccttcaatatataataaaaataataatacttggtcaagaagctaccactaccaaatcaagatgggattgtgtaaacgagagttatcaacaaaaagaggcaacagttgagagttaggacgctcatcacaccacgtaaaagagctttcaagaaatagatagaccgatccgaatcacatgcattaccgaataaaaagttaaggctgagaatgaaagagattttttctcgcaacttcttcttattattatattcatgatgataacaaaaatatataacacgaataataatgctgtaaaacttgacatatatctgaatattctctaccacaagtaacagcaatagttcacacgtcatcgccgacgtggattcttcatttcccggcggtctaacggacgtgttcaattccgattctacccttgctgaaactagatattccccttgtgcccctgactcttcgaaagcattggctctcacctcaatccaaccgtttgattcccattttgcccctccggtcgtcgctaatttactcatccttgccatcgccgaaaccgtagactcaactctagctacatcgctcacttcatcttcttcgaaatccgagttgacccagtccaatacgcaacgcggagacgactcggtgacaaacgagtgatgatcttgacacagaaacggatgctccagaagctggccgcagctccatctctgactccgatctcgtctcaagcatttgtccaagaaatcgcgaccgagctccgaaactcccgccggaataaacggcagctcgtttgaatacccgatccgactcagcgagtcgaatccgttatcttcccacgctggctttctggtgagcatctcgatgacggtgcaaccgagagaccacacgtcactctccggcccttgatactctctccttatcacttccggagccatccaaagcggacttccacgcggcgcaatcccagccgtcggttttttaaattccatcgccgatccgaagtccgccagcttaacggagcttccgccgttaacgaccagaacgttcttcgatttaacgtcgcagtgaacgattccgttagagtgaacgtgaccgagagcggagacgagacaccatacgtaacggcgtatgagagtttcgtcaactacggttccaccgtttgacaggtcaccttccggtaaatattccaaatggagattcctgaacgacgtcgttccttctttggacacgtcatcgccgaggaacctcacgatgtgtgggtgggacttgagagagcggaggattgtgatttcgttctcgagggactcggattgagaaggaagacacgtggcgagatctactgacttaacggcgaaaactccaccgtcgatcttactcacggctttggttaccgttccaaagcatcctctcccgatacaagaacctcgaatccaaggagatgaagaagtgtttgtgatgctctgtttctccatgtgtttttgtttgctaactaactttggtgtgtaaaattatgaagtacacacgacggtatataactatatatacgtgtgcgaaagtgtcaaatgtgaagcacaaataaagttgggagttttattaatttccgacgtggacgtttcttttctacttgtctttctgacatttgaaatcgtgaagccattttaagccattttaaaatacaataaaaagtttcccacttgggaattcagaactaactctcgaattattgattataatattttaaaattagacaaatggataattgggagaacggtttgatgaagtcagttcgacacttggtgatgttcttgggatgttctgtaagaaaaccgagtactttccatattatccttatccataataagattcaagttgcggtttgatcaggtccgttgatctgttacctcttagacactgttattttatttgagtgtcatatagaaaaggtaacatatatctttgtaaaacgcaacttcattttaaatcatttatttactaagaacagaggaaatattattttgatttactattattttataaatgcaccatttttatgaatttttataaaattttatatgctgaatatgtaagatgttttcatattttatatgtaacttttaattttataaaaaaatgtaagattagtgatattttataatctatttataattagttaaataatttaaatttaaattttaataattatttttatataaaaatatatatttttaatagttgttcattgacgtaaaatttcatatattttagaacaaatggaatgtacaattaagtgtttaaattgttattttttatgttttaatagtttttagtattaatttgtacctttaaatttgatatacgagtttaatgggtattgggtaccctttgataattatcatgttcttttttgtgacaagataattatcatgtttaagtatcactaggttttgacccgtgcgcccgcacgggtgtatattttgcataattatatatttttgttagttgtagacttgtaagttaatgttttgttattgagttcttatatatagtgtatcttgttcattttgcttggtgatgaattttaaactattagttgtatttattttcaattgtacttttttttacctttacttggtaaattaaacaattaagtgtaaaatattggaatattttgtttagattaggtgtgttttattaaattatactataaaatttttgtgatttttagagataagcattacttggttgacaagttttttgaaagataattatgtgattgcgttagttatttgatccttttttaaatgctgactgcgtacaattaagaaacaatattctttgttgatttgtcttttaataatcataaatttatgagtcgtttttggaatattttctcatatggaagaaaataagtttaattaggtacgattttatatgtaaaatcttaactaatatgatatttaaggagcatactatacgcatatacaaagtataccaaattgataaacaataaaaaatatttgactttaggaaccaaaatctaaaccataaaacaaccaaaccgtacctttattatagaattaatatactaaatgttggtatgcatagtcataaagaatattattctctgtttatatcatgcatatgtaatagaaaacgtgaatataatggtatatatacgttttgatatgaaagatattttgtaaatatatgttcaatcgattggtttgcaacgggttaacagattttgaaacatttggttattgattttttgtgttcggttgataaaattctaaatttagcattgatctgggcaattaacaatttctaagcccaaagcaatgttatgggtgggtaagaaagacgaaaaggcaaaaatatttcaaaaaaaaagaagtaaaatgacagaatttgatggcagtggcatagagatgtaatttttgtgcaactctaaggggtaattactgtttgtacttctgctttaatagtttagatgtttactttacaaatgtcatacttacaaaaatattaaaatggataagtcaacggctcttgtttttatgctatctcatttcctttttcaaccataacttggaaaaaaaatacagtatatgtgtatatatatatatttatttatttttttgatcaaatatatatatatatatatatatatatatattttatttttttgaaaaatatatttctcaacaaataaaaagtttgttgacatttactgttgaggccattaggttaggggcgacaagtgatgagatctctccgacgaatcctgggaacggcaaggcaaactaaaacgtgtcgattgattttcggtcatttgtttccgttgacttctgttgatatgcattacagttttctttttcttttgttaacacgatcagacatggaatattcggtggtaatcaccaatcaagtactcactattcttagaatcgtgatactaaagtatatcacgtaataagccaatcatatacgtagaacttttagcctataattacaaaatgacatcaactataatttataagcgattgttttgtgtcactgtcaagtgtcaacaacttacatgtaaatacttcgattatagttcagtatttttgatagttttggctcaatttggaagtccagtttagtcccagcagaaaagaaaagaaaaatctcaaagaactttaaaattttcaataaaccaatcagttccctttaccaaaccggactaaattgattaccaattttatataaaaatttgcccagtggattccagcttaaaaccgaacccaaactgaattaactaaacatagactttgcttgatatggttacgtagtctgtcaagccctattgcctaataccaatacacatctcgtcatcataattttaagttaagacttaagacacaatacgctttgtatacgattaactagagtcgtaaaatatgtttaaaatacgcaactttttgaattgttagcgcttaaatcattgtcaacaatcaatgtagacgagagtgtatcggtacactgcaagtacgtgtagcgacagagttagttgtccaacgaagtttgatccaagacatgagaaagagaggttcatcacttaaaacttttaagcacctaaaaaactactttggtgggtctactttgtgaatctaacgtgtcaagaagctgttggtccacgttctccaacagagcaccagagactccagttgtccgaactcacttatgtttctgctcgaagattgcactattgacgtgccttcaccacctccaccaccacatctactttaaataacatttttttgttctttcgttaggaaacaaaacatagaaatgtactcaacgtgatccttgaggaaatgagaatgaaaaatgctagtttaataatgttgaccaagaaaaaagataatcaaggatttattcaatatacttatcagttactagcaaactcatgagttgacaaaaaaagcaagtgaataaataagaacttcaaatacttctgctgcttatatagactagccatctattatgctatttacatattaagaaaacgtcattttctgaaagaaaatccgccgcaactatcatatataaaagggtggatatatggagtatgttgttaaataagtttattttgtttgttagcttctgggagagatctgcccctccatgaacatgaagtactatatcaacggtccaccacttgtaggttatcctttcgcttagagttcaaaaataagatatcattttgagatttaatggacccataccatattaccaagttacagatcgagcaatcccacttggaaaacatattagacaatgcaagtgaaagtgcaacatgccattcgctggtactaactttaatgtcactttaatgttcttttctaatggaaatcgactcagacatatgtatagtaatatactcggagaagagaaaagtaacaaggtcatgtatttactcggaaaagagaaaagtatgaaaataaagttaagataatcaggaactatttgaaattaagtcgcgtggttttagagacaatatgttgatttgctttaataatttctttaaataaaataaatagtatatttgggtactataagatgcatggcaaagagcaaaacacaatatagacaaaagttgctgtttatgttgataagtgtcgtgggagaagaagacaaaaacgaagcagaaataactctaaactaaggtggccgacaatacaacatgcttatgttattgtaactcgggagaaacctctaaaaacataatcttcgactttttttatataggatcggttcaagatcatgcacactgatcctcgtatcacaaggataacgatcctatcgatcggtagtaagaggtgcagtatcatgggtattttactcataacaaaattgtggaatctgaacggtggaagcattataagcgtagttgaggaggtatggaccgtcacaatgttatgtgaactgctattgcagtttaataaagttgaatgtaaaagttttatgtatttatgcaaagtttaatatgatgattttttaaaaatatgtaagcaaaattgtaaggttttgactgtaacttcaaatgtcaaaagtccaattaatgatcagtgaagactgcacattacttcaaattaataatggaagcagcctagtgattctaaaagtgaataaatcttttttgatacaaagttttaggcaaatgcattttagattaagacattaaactaatgcttagaatcagataattcgaatttcagaaacaggctactataaaaaatgtatttcttcatgatttgattgtaaacaatgagatgagaacaacaaaatgatcaacaaacatttattagtttagttacattgaattggtggaacacatgatgtgtgtgtgggactgaactgctaaattggcggagactttgtttggtaaagtaaaataaccaacaataaaaagagaaaagcttaacaacgtgtcgttttggaatccattgagaaaacaaagaaacagcaacgtattctccgcctacaacacaaaaacatgagtttatatttcacgtgttgctttttcgttttcactttgaccattgtcttcttcctcttcgtgtcggtaatcattatcagcgcacaaattttaaatttactttgaataaagttgagttttcaatctatgaaaatgtttatgacaatctcatagtgttgattcaaagtaacgtaagtgtccatcatcgatatggttgaaagtctaatgtgaatacgtaaaatgtggacgatgtgataaatactactactagactaaaaggaccaacaaaagacacaaccaaaagtagtaacggttctcagttcaagggttttaattcaaccggtggacgaattaatttagaggcttaacaaagcaaacaaagactacaagaaacagagacttgttttggcgcggtggaggatcttgcttttggttgttataagtcatacaaggtttttgtcttcttaagtaataaaaacaaacgtttgtggatgatctcatgtcgaagcgtgagaaactaaacattctctaatagtgatatattggaaatgagttcttggtcaaaatataattaaggtatatataccagagcccatcccaagttcaaacaaagaaagcttgagcttgtctgcttgtgctttcaattcaaataaatatttagaggccgttgaatactgcattatttttatagtctagttgtgatggtttgtaaatgtgtttaaattgctgaggagtcgcagctcttttttacctcccatatccattaattttgtttgcttccgcggctttcaaatacttaggccggctctagacctttcatattgataaatttgacataaaccttttttatgtttgttccacataatttctaatctattttaactcttgttgatatgaaatgcatcgaaagttaaggggttaaatccatgtcaacattcaacaacattgcttgcatatgtgttctatgtgatgtcagcgtcctaaacctttgctcagatacatatcttaggtcaaaaagactcccatgacatgttccagagtccatagggtgagggaaggttccaatttatcaatgcaaactgctattcgcatagtaggctaggaactcgcatcaagcatctggtcgagagacgaaccaacgaccattatgccaaaagacgggccacatgaagacttggtcggcccaaatggaaagttaaccaaaaaatttacccaactaaacctccataagcctcaaactagaacatgcaccaaagcttcaggatgaccacatggtcgaccatgaagccaataggaagtaaatggaccaagaagatgttttgatcatcaagaacgtggaagagcttaaagactcgagccaagaaaactctgaggatgatactactacaccaaggactactcaccaaataaaccagaacgcatcaaaacagccaagcaccaacctggatcaagatacatctaaactaggtattttcaatttaaacgatttatgcagataagatggaccatcctagtagttcctaacgatcattcatcccatctgacacaccatagttttaggccgcaagatagtttatataaattttcttccttttttcttgtttttttcccgttttggtcttaaaccacaaatgttagttttttgttttcttttctttgcaaaagtctttttgtcttgaatatacctctgtgagcgtaataataagggcatctccaaccctactccattttttactccaaactcaattatggagtaaaatcttctccaaccccactccatatttaactccaaaatggagtaatagctagggttactccatttatggagtaatcttactcattactccattttggagttgaattttttatatttatgaaatggttcttttaatttttaatgtttttatttcatacttaaaataatataataactttaaaaaatataatactccgaaaaagattactttatagtttacagaaaatatgcataaactcataaaagtcaaaactaagaataaataatataaaataaatataatataatatgaataagtaatttaataattaattcggtaaattgttttcgaaactaccaaaatcggtgaatattattcaaacggaatagatgagttttttaatcttgtgggtcaaaattttgattgataacatttgtacttgttgagcttgatatatgcacaaacaaacaataagacccaatacataattcaaattacaaaacaaaactttgtttttttctttatgttcgtttaatgcataaaaatatttttgaattagaaaaattgcatatgataaaatctgcacgaattgaaattggaagataatctctagttgtatttttaatgataaatatttagtttaaataaaatatattattatggaaattttgtaaacataaaatagttgggttaaatgttaattttttataagttgaaggtactaataacaattattaactaaataaaaaaaagaatctttttgtttggagtaaaaaatggagtaatacattggagtaaaatccaactctattttggagttacaccattttaaagtaaaatttggagtaatacattggagatgctctaaggctctgcgtagctttgtacaacacacttttacactagatcaataaaataacagagttcaacctaaggtcgtcttgttcttgagttttgggactttgttcttcgggtgagattcacctagagttaagtcttgtgcagtatcaaatatcctttcatcatttttgtggtgtcattcgatccactagcaatctcgtcaaccgttccagcaaaaaaatgagagtcaacttgttagatctcattccacaagttttgtccaaaaaatcttgtgtccgtctttcatccatccaactgccacgagaaagagcatagtagccagcttatgtgttccatttcactattttcaaaggctcaccaccgagtcttatttcacaatgaattttatttcttaggtggtttcattagtttcaatgtctaaaggattgaaagtagagagcacgaatgaataaacagattcaacgacattccaacaactagacaaaatcaaaacacatattacctttacatggaaactagtttgagatacaaatacaactgataatcaaaattaaactacttgtgtggaaataattgatttccagtttggcccaatgctggtgaaattttttagaaattgtttaccggaatagcttgggtcctttcattctttataaattctaaggtaaagagcaaattaagcttaaacacatccccaatacacacgtctacaccacaaatcatgttctaattttcagatacgatccacaacaaactcacccacaaatcagaatacacatactcattgtttttcgttcaaactttcatatacgttgccatcattcttctctaactattctttctatccaccccgtgtttggatttaacatagacaaattcggaggataataataataaggaactgataattagattaaattcgaccaaatgctcgtttcatacaagtacctcttcaagttagaaagaatgaataaatgaattatatcaaaagtcaaattaataaaggtaaatggacgcaagcccttcagatttctatctaaaatatctaaggatctctcttatatgaactggtccaaagggatcagcatcacactaatatcatccaatgagcctcgtgaagccgaaagatcgacaagcttcttacagcccaacaacaatggcttctcctcggttcctaggcagaagggacgagcaatgtctactgcttcttggttactcactttgtcccatagaccgtcagatgccaagatcaagaactcatggtcctgctcgattctcaacgtctttgtctctggttcggctataacccatttcttgagatgagcatcaccgatccctcttgacacagccaaagatccttcaactctccatacacctcgaaacgtatcaacgtatccaccctgcacaaaaaaaaaattgaatctacttttagaaactatactttccatttgtataaaacattaaaaaccgagattctcaccgtggtttcaattcttgtccgttcatcgtccctagacgggcggtggtcggaagaaagagcctccgcgactcctccaacactcatgacggcgcgacaatcgccggcattggcaaccacgaggttcccgtcgctgaacatagccgtgacgcagcaggaaccgcctttaacgtcattctcgttgagaaacgcagcgtctgtggtcaagtaaccgcgtttcaccgcgtctgcgatcgctgactcgtcgtttttaccagcaaccgcttccaaaacgttcttgtctaagttcttggccgcaaactcagccgctttagctcctccgtgaccatcgtaaacaccgaagatggcatgtttgcgatctccttggagattggttacggcagagaagcgatcctccatagcttctctccttcctctcttgcaataaacagaatagccatcgccttccctctccacctctctaccttcctccctcggcgtcgccggagcaacgaacccggtggtaccgatcggtatatcaagcctcgtggggcgtttgcgtttcagaacccctccgggaggtgattggccggtacacgacgccggagagaaaccggtcggaggtttctgtaaacggagacggaacggcgagttgagggacgccgcggcggcggaaggagaggaaggtttgagatgagaaagagtgagagagatggtttcttgcggcgaagagaggatgatagaaggtttgctgcagaaaagagacgacgacggagaaaaaaccggagagttacagacggaacaagacatcgtgtaagagaattctgagttcgaagattgatgtgtttctttctctctacctttgagatatttgttttaggagaggaaaagaggtttctattaatataaagagagagagagagagagaggtaatgaatgttgaagactttcaaagtggtaataatggagtccgtgagggtaatacggacatttaaaagtaagtcaaaaacacgtctaaaaggaaagaggaagagagtgttaaggaaataaacaaagaatttgggcatgtggtggtttaacgtatcagtgttaaagaagtgtttggttgatgactcttcacgttttttcaatttattcttttgtttttaataataaaaacagattctatgaacgttgtcggtccgttagagcttatgagttgtattttgatgggattactttcttttgtttcttggtggtcccagtcgcagcttcttagcaagtgaccgttgtgtggactgagaggagccttctttctttctttggtttttcatttgatgacctttgtaaaattatctatctcaattcactcgaggtcttctaattaaaactaacaagtcttctaatgacatcaataataacggctacttctttttccttataaaacggtatttgtttatggatttatgtgctgactgctgaagatcaaacattggcatccataaggatcaaattatcttattctctactagcaacttttaaaacaatgctttaacaagctactgattttgagtacccaatacatattttctgtggtttttttctaacactgaaactaatccattatttagtttgaatcatgtattatcaaggatctcaataagcaaaagtatgaataaaatttatgattctattcaaaatatattttttagatattctcttttcgttcaggaattccaactactattacagacttgtgatggggattcagtgggtttttttataaatagcaatcatatgtataacatcattatttgctgcgaattgtaccgtcattagtttgagtatttacattaataagtaatggtatgattttctgttgtgttcaaatactgtttatgaagaatgagtcatatattttaccctacttttacgattagacttggtcattaagatagttgaccagataaaatgattaatcaagcaaagaagcttcccactccataattattgtggtcacttggttcactttgaagttgtcttcgaacgtctttttaatagtactaggggttatctgtgttttacgcatgaatttttttattgacatttatttttagtttaaggggttaattatataattgtgaaccattatttttgtgtgagctttttttatactccatatgttttaaaatgttgtatattttagatttttcacacattttaataaaacacattaaatttctattttttttgtgattatcttttttttcataaaagattagttaataaaatatacattgaaaatgtaaaaaaatagatcttcttgatacaaaatttttctctataagtaactttataaaacggaagaaatataagaagacataagaatgtgtttaaaaaaaagacataagactatcgagagccgaactcgttgtagttgagtaaattgcataatgttatagttgttaattttaatggtataaattttatttagaggacttataatttgtttgatattttaagatcatccactattatgtgatttttgtcagtttattacaatcatattctgctatttaaaaaaaaaattgaattcacttttttttagttttccacaattatttggacaaaataatcttacatcccattgttaaattgtgagaacaaaactttcatctatctacaatagtagcaagcgtcgcatttgtttctgatgttcttacaggtggatgttatcgttacgtcatcgtgtgattgttgtttttgtatttctataaattcttaaataccgtggtatgattactctagtttcatgaaatgatttcctgaaacgtttccagcatcagtcccctttatacattacccatgcatgtctaaatatacattaccaatctctaaatatacattaccctttgttattatgtgaagatgttgtagttcaatgcctactccgtaatgttgatacatccatggacttgagaacgggcagaaagcaccagcaccttttgttataacagtatattttccagaggaatttggtggtaaacataaatacatcattaatcctaatcaaaacgactaattattattgtcaaaagatcatgcgactagtcgtatgtcaacttacgaagcctgcaacaaaagaatatctttttgtaaatgtggattatttcaaggggtgggtcggacacatgaacagtaatgttaagaagtaaacctattgggccaaatgagaccgacgtaggcccatagaaaacccatgacgacccgtacactagataaatgcatattaacttcgaagacaataaatacagaggggtccacgtttccgttgcaaattgggcagtagacatcctccccgtgaagcaaattcaaagtcttaccagtagcgaagaacacaaaaactaactcgctacaatcttctcttttttctttttttttcaatgttctctctcgacgaaggtacaaagatcttgtcttaaatagatatatatttttatttaatctaagcatagttattacacagcccctcagccagagagagaactaagatgtacaacgtgcatctttatcagggggttaaactgacataggttatttgttaattatatgtttttaatttcgattaaccgccgagtaaaggtggttaattaagctgcgaaaagtaaaacctacataggttatctttagattatatgtttcttattttgattaaccgccgagtaaaggtggttaattaagcagcgggagagttacaggaagattgatgtcggagatttgtccagatgacatctctatattatcagcttcggctccctcaagatttttcttctcaatctgtaaagataattataggtcaaaaacatattcacttctctttttgccttctatgacttattaatacaagagaatatttttttcctaccaaccatcatatatatagcaatctggatttcaaaatttagtttttcttttcctaccaaccatcaaatatatagcaatctggatttcaaaatttagtttgtcttgtttctgactttcaagcttctaggtctttcaagtttaaagaacatgcatctttctccaaagcaggtatctagcttttccagtttataatcaacctggctgaactagctaggaaagctatggctagatacttgaacctaccaatcttacccaagccaacctaaaccatataacaacaaaaaccccaatcggttccataaatctcaaaccaaattaccaaaacccaattatgtccaacaacagggaagagattttactatatcaaaattatatatctatcaaaacccaggcttcattggatatataattggggaaaacctcaaaaccccaaagtataaaaagactgaatcatttatatttaaagaactataccacttcttaatttttggggtaacagtatcaaggtttatgaaatagttttgaatttacttttagggttcagggttaggttttaaactgttgtgctcatctaaaataattttattattactttactttaaaatttagactattttcataaacgttcttatatatatatacacaatattagaaccgaatcgagattttcctcaaccaataccagaccaaagaaaaagagaataaacattggcacacgaaaacagaataaacaaaatctaatcaaaaaccaaaatgctcttattaatctcgagatgtttttttatattaaaagtgcttatatatgtatatatctgcaagtaagtgtgtgtatatgtgcaagaagtgcttattagcttttgcatatttataaagaatgtagcttttcgttacctgactagccaaaacctggttctcttctttcagcagattctcctgtttttaaaaggacaacatgtacatcaattaatttcagattttggtatccaaaacatttgcaacatccctaatagacaagatgcattgtgaaatgtgaagaagtttgatgtagacctgcgagctcataaagcacacttagagaaactaatacaacaattgtgccaaaaaaaaaaaaactaatacaacacacaagtgttttgaggctctcaacacgagaatatatctataagtgctataaaatcacaaatctaaccttttctttgagactttcaacaagctttaacattagttctgcctgcaacaaattaaatataagtgcacaatcgttttcgacaaacaaagtaaacaaagagaacacattatggagtcgatgtaccttccgagctctagttacagagagggcagtctcaaggtgatcttctagctcaacgagggaatccacgcttacatcatcaattgattccacaagcttgctgcatatatgcacagattgacaggaaaccctaatatatttgtaatgaaaggaggagagcaaaaatagtctcagttagtactaacctttccacaagttctagtagctcatggtgtgaactatagttcagagattttgactgaagatcctgttcacggagaaggataaaagaggcggtaaaagaccagtgtatttaagaaatttgatatgcacgtggaccaataacctcacacaggatcatttggcgaataatagttcataacaaactcaagttttaagaaatttgttctcaacatgtgtttacattatagttcaaaaaaaaaaaacatgtgtttacatatgtttatcgaaaaactactctaaaggaagcatcgatagataacctcttccatgttgaaaacaatatttgacaactacagctctcaaataggaatgatacacgcagtttaaatgcccgtgagccatgcccacaaaaagtaagttgaaacatgacgctgcgagttggttctgaccagtatatatggagctctctaagccttacttatatccttaaatactgcatgaggaaatattcaaaatgtttgtattaccagggcattgagatcatcagcatgttttttcccatatcgatcaaggatcttctccagtctggagaaaagataaataaaaatgttaactgagatcaaaagtcaaaactacttgttaacccttgaagacaccactggaatctatcaaaacattaaaagagaaatgaaacaaaaggttaattttcgcaccctagaatttgctaacaattcagaaaaaaccgtagtaatcaggtttaagcagcagcacatttggatttccatttcttatttttaacatgctctgatcctttctaagcaatctcaataataataaaaaagtcctctaaaattaccaagtatttcaagtttaattttccaatagttgtgttaggttacatgtatttatttatatacttgatagactgaaaatggcattcttttgacaaagaaaagtcataatctatactatattaaaagggttatatgagctccatacagcatgtccacgtaggacaattaaatcgaccaatcacgttgaagcgtttagccatgtcactaatatgttgggctcacggtttttcttttgtgtatttgttacgattgggctcaagcccatgaaaccattataacaaacaatcgcactctttcacgttttttcgaaaccaaaatcagaacgattctcatcccctttcctcttcctcttctttgatccgtttcacgatctgattcatgagcaattgattcatcctccacttcgttctccctttactctcatttatggattcgtttttctcttcttttgtttataaaactcttgaacggagtttcgtttcgattaagcttcgtcgtaaattttcattcgtacattgcaatgagtttcaccggaaaatccaactcggagaaaccacaacgcgttgagggtgactcctttcccggaccgatcaatcccatcggcgatccccactcgaagcaagccaaagtcgaagcgtcgttctcctccggtctgacgaaattaaaggctgacacctttcccggaccgattaagcccatcggcgatccccactcgaagcaagccaaagccgtagcctcgatctcctccggtcttacgaaattaaaggatgactcctttcccggaccgatcaagcccatcggcacacctgattcgaagaactgcaaaggtaagaaaccttatcgtttcttatcaaattatatagtccgtttgatttccaaaaaaaaatctgaagctttgagatttaaaaccatgagacgaacaaattttttttttaatagataatttttatacaaccgcaaaggtaagaacccttatcgtttcttatcaaattatatagtccatttgcttacgaaaaaaaaagtctgaagctttgaaatttaaaaccatgagatgaacaaaatacttttttttataatagattatttttatactatagaaaatagaaaatcatataaattgtggtacggagtttagtatccttttttgatgatgagaacgttcgtattcctatgcaggtacgatcaatcacaacacgaagactggtttctcttcaggcgttagaggcaaagccgctgtctcctctgccgtcaagggaaaagccattgtctccgccaaagtaatggctttcaaagatgtgaaatacggacttcatgacggcgagctgaggtttcggttgatccatttttgggaagctcgaaatgttgtgacgaaggtgcttctcggtctcaagatgcttctcatcgactaagaggtataaaccgaattcttgattgcgatttagtttagaaattgttcagacaagatgctgataaacattttagattcaaacttatcgctctattatttatagcaagtgtttgcttttgtttgacaggagggagctcagatattttaggaaagatgggcacaaccggaggaagaagaaagatggtaaaacgatgaaagaggatcacgaaagctcaaggttaataatatatttacattcatgttacctcagtttttaataaatattttagagtaatattgtttaagtatatatctaggttggaagcattgatgtgttacattgttactaggcacatggggaagacaatgagaatttcgagaggctttgctactggatgcttgaacagtgagtcctatgttttccatatttcacatttttaccggtttagtgtaccgtaaatgttactttgagaacagaaggaaaatgaaatgtgaattgttacttttagtgcttatgtcctctgtttttttatgggtacagggaactgatgcatattgtttttgttcaatacttggaggttaaggtgtagcttttctcttggtgctgtactaatatattctttagaatataaacatccattcactcaacattatattgtttctttttaaagtgggttctcttttttttaatggtggctttgataagttcacgctatttatacagggtaataggataagctccagtggaataaaagaaaacaattcaaattctgtgagtggctccacttctgtgaatattgattcaatggcaaacacatccagaacattgtcaccactatgtgaagatgctgattagtatttgccggagctttaccgtggagtccgttgtggccgtgttattgacgttttagatttgaatcagcctacacggacctaacagcaacagggattccagcggactaacagaagcagccgtggagaggcaaggcagggacgagattagcggccagaaatttgaaaggaaatcttcagaagaatcagatagtaagatagttggtgaagaagagaaggaagatatgtcgcttggtaatgatagtggtggctctatcaaggcggctacacatgacaaagacagagatacttctccttcccatgaagggataaagctttctctgtgattgtgctgtttaaaatgatcatttatgcatagccttggtttagtatttttggtttataaaggtcatgactacaattcaacagggtattggaacgagctactatgggcagcttcgtgttctctctggaggtcaagcacctggtgggcacactgctatatatggaccattcggtaagtgtttaaaatacatttttgtgtgttttaaaatgatgctttacatcttagtcatatacttaattaagaaagcagagtagcaggatcactcttatttcaaaatatgtgcgctttttagaagtttacatttgatgtcataattttgtgaatcagtgtctcgagtaatcaaatttgatgtcaccctaacttcaaactttgctattcacatccctcaaaacttattctctcagtgtttgcatgcagggtgatccgaagattatcacctgcaagttttcatgctgctgtagcaaagacatgttttgaggtacggtaatattctcaaaacaccagactttgactccctttgcataacaaattcttctgcagttttctgattctaagtatctccactttgttattcactcagctgaagaatcaactcatcactgctagctatgttgatgatgaaacatccatgtagatggctaagaaatacttggattatgattcttggtgaagtgacatccacaacttggataattgagaatgaggctcatatcagcaaggggaaagtgaagtctttcacgctcttcctgtggtagcattcccttttcttctgcagcagataatttattagcacagattgaattacttcaatctgatgtattcaaatcatgcaataatgtgatcaagagctcacattcaccttccactttgtaatatttattatgtatctttttttttgggaatcataataagcaataatattttacagtacatatgcattacaattacaaccaaaagaaaattaaagaaaaacagtgaacatataaagttagcttaaaaagggaccccatagagaaaatacatttaaaatatatagtaaattattaaataaacaaaataaaattggaacaaatttaaatagtaaatatatttaatgtataattttaaatagtaatgaccactattaaatttttatgtagtttacctgatttaattatattttcagttaaaatggattaaacttcacaacttattacttataacttcattaaactcatcagcaatttttaaaaactaattctaactattaatatagttaaactaaaacaaacattaaaatgaatagtcaaataaacagaatttttttatagtaaaaaacatgtcggacgttcgacaactgtctcgcaacgagcttctaccaagagatataaatgttacttgcacagctcgtgaagtcctctgaaaccgacttacgttacgcaatggcgtcgaccccggttctggggttggcagcaggagactcacgtatatacaaggacctggatctccagacgcatacattttcctgattggcttctatcaaccgtttctgtgatcttatggatcgatgtcttgctagcggtaacatccaggcacactacgtgcaaggaattcatgaatatttttgcaacaacacaatcaatggcatgcaccatttacgcgtctcagcaggtggttcttacgcagatggtgtaatcatgttgtgcagaggtgagcgagctgtcggtcatgcctacatatacatgcttggttggagggagtccccaactaaattagacgaatactggagaagaattaaaacttcgcttcatggtattgttgttgcgagactcccggtttacatgacgacgtaccaagaaacaagagctgctattactagcctttgccaaaggaacctgcggaagctcgagccaccggaaagatgccatgtcaatgacatggacaattactgcgagctttgcttatgctacaagtaaatcaagcagttcattgctatcctttgagatcacattagtgttttgcagttcgttgttatatcgaatcgtattccgtaccaaatccatggtaatcgcaggaaaatttgatttccggttttggctggaagtttgctttttgtggtggaaaaattgatttcgtggttttgactgcaaattttgattttctcggctttggcaaaaatattcgattttgtggttctggcggagaaaaagaatttgctgttttagcgggctggaaattttgtgtttacgattttggcgggaagattcaagttcacggctttggcgaaaattttaattttgtgattttggcggaaaattttgctcttgcggttgtgacgggaaaaaaacaattttttattttggcagtaaatttcaattttattttattttatcgagaaaatacaatttgtggttttagaggaaaaatctaatttgctgttttagatggaaatccgatttgcggtttagaggaaaattttaattttacgggtttgccgaaaaaatcgactttgcgttttttgaaaaaaaacaactaaaacctcattttccataatcaatctttaaatatttttataatatttttaaaaagtgtttttttcttccaaatagtcttacattaaaaataaatattaaaaacagaagatcatatatcattttaaattggtcaaaacaagtttaaatgagtcaatgtaatatttgagggtctaaatgaaaaattctaatagatctattttaaaattaatctaacggcatagctattgaatggggtgagtcttaattttttttttgacaacatgggatgtgtcttaaatggggtgggttttcccattttaacatccatatactccaatgtaaagaatataaccattagattattttggtttgacattagaagttcggtagctcatataaatctaacaccatgttatgttgtcaaaggtttcggacattagtaaattaataaaaatgtagcaatcaataatgtgaatttattatagtatatattgttatcagtctaagtataaaaatatatttatattcagatacaaattataaagtaatttaaatttaattaaaatatatggaaaataacccgggcgtagcccgggaaaatctctagtaacattaatacctgtacatgttatccattaatctatcaattaattcatattcaacgctggcttttgagtcacttaaataaaaattaactaaggtacataagaaccctatactcaagtcaaatacactttgttttgcctctgcacccacaactgtttctttgcattcaggtttgtgttccattttataataatttgatactataacaggaacgacgactgaggcttaaatgagagtgtatatatattacatagaggtaaaataaagtgtcccaagtgaaagaaactttgttttgattctcacttggtgcatatagaaaagtattccataaaacgaagacatacaaaataaggggaaacaaatactacattttctatttatgaggttacagagacgtctaacgcatttcgaaaaaaattaccaacgcagttaacagtttgtattaataggttcagagttccattgtgaagttaatcttttgcacattttcatgtgcaaaactaggagtttgactactccaaggctgaacctagcattcagtctaaggcgaacaaatcctagcaaagtatgcatcgagtgagaatcaacgatcttcaccaaaccactagtacgacttggttatactagagggtgttagtacaaacttcatcgattaatttgacaatgtaggatcatactgaatctagagagatactaaaggggttggtattttttatgaagacgaatgttttttgtggggttgtcgatttccaggaggagccaaagaaacagggcgtgtgttgctgcacttcccaagacaaaagacccaagatttcatataccaaagcgacaacgttaatttaatatagttcagagagaataggaacaaagtgttgatatataatgcagacaatgacaatgaaaataagaaagatgaacgaatatccagtcacattaatatgtagcatataaatgtatatcacactgcgaggatgggaaactaaaaagtagaaactagtagaaacttgtaggatagaaattccttgaaaccatatatccacattaatcttagtccatagatacacaatctatcatacatttgaaaaaagttaatgatctattttaccatcaactccatactatttttataacaaatctcccggaagtgcattgcaatgtataggaatccaagagaacaatgaattaaaattagtctaaagttagaccaactgatgcacattacgtgctgcacaaagtatcaaatatatgcacacacacaacgattgccgattaaagaatcgaagtcgatactgcatcacataaataatatagcatatgtgagttaattaagaactaattgtgaggttaaattttcttaaataaaaaaatactatatatatatatatatatatgtatgtgtgtgtctgtgtgtgaaaatcaagaatcagttagaaaccttaaaattcggataatcttaagtaataattcatggtaaaaaggataaaaattttgaagatctaaaattatcttttagtcaatagctgcacaatgtcgcatacattcaaatcaaaactcttgatctagtatccagcattaaccccacatcagttttaaggatctcttcgcagtgcattgcatacagatctgagcgaaccaatgattgtagttacgataaaggcagacagattaattaattttctgatgcaaaatccctaaagccaatgaactaaaagatggcttgaaacattactaaagaacatcaagtattcatcacaacgtatcgagaagatcttgacggacatgcaaatttttaacaaataaaataaaatccatgcagaaaaatagaaaaaaaacgaagaaaataagagagagggagattgagtaagaagctttagctcatcacaacattgttcttcctcaattttggttatatcatgtatagaggaaacaataacaaacaaaaccgaaaaatccataagagattcgccgggtaaatctaagtgtcttttaattattttattttaattattttattagtaaagtaaagagaagaaagcttaaagggcaaaaaaataagagagagaggagaagtcctacctatccccggaggagaagctgtagagtttgtcggaggcggagacaacgagaagcccaacagatgcctcgcagagaacagaaagctgacgagctttctcgatgagaccgttgcgtcgtttgcagaaggtgacttgtctgctactgtttttctcgattcgcttgatttctagtttttttcttcccatagcttctgtctccgagaggtctctgtgccctaatttgattctgaggtacggttaaagtcgccggagagactaagcgttttattctttcttctttttcttcctttttttttctttaatttctacctatttttcctcgggtagggtttttttgggcgggggtaaacgagagaaataaaaataaaaatatgaaagttaaaacgatgcgttttaacgacaagacagccacgtgcaccgcaggacgaactccctgtggacgcgttgcgtttgactactcgactctaccatacatacacacaggtagtgctgggaatatgaatcattatccgcgggccccgccccatttgatccgctgcggggcaggtgcggatcgagtgatttgaaaaatttggttcgcgggtgcgggtgcggattgagtgatttttatgcggagcgggtgcggatcagccaaaattcagtgcgggtacccgccaacccgcaaaaactaaaaaagaaaagatttttttaaaaaaatattatttttaaatagaaaatttttaaaaaataatttaattttaattataaatagattaatatttattattttaataaaaatatttaaaatattaaattttattgttatttttaataaaaaaatatttaaaatattaaattttattgttattttaataaaaaatatttaaattaataatttttaatattattaatattatccgcgggtctagcggatcacccgcgggttttagcggggcgggtgcggatttcatatttttttcttgcgggtcaagcgggtcaaattttttgagtaaaaaaaatcagtttatccgcgggttggcgggtcagcggggcgggtttgacccgcaatccagctctacacacagggtgtgagtgaaaggtattaatagagtaaaagtttattctatatcaatatttactctaggttgagctaaaatgttaccaatcaagtggaacataaatttttgttatttactctatgtactgtacacaaagagaaaaagagacactaaatattactcttgattatgctagaggtatatgattttactctatatagatttttcttctcatattttcatcttttacatttttcactgagtttcactttttcatttcctcctttatttaccaatcacactcatatagtaatttgcagcacttaaatatataaaaatcaaaatcaattttcatgttttttttgtataggtgatatattagtttttaagtaaaactcatataattctaaaatatgtggcgcaattttagagcatatattgataatttctcgaaaagccttccataaataaaaaattaagaaaaatataagaattgtagacattactactcttgctcatttcacatttatcaaatatgttataactgaatttattttaatattattaatttttttgtcttgagaaactaagagtatcattactggtcagttagctaagaatcgtttctagtataacaacaatagaatttgatatttgtaattaatttttaaacacaaaaaagtttaatcagtgatattgtgacaagtaagcaaattagtttctcaatttttttacgtctctttccattgataatttggtattctatccattggaattgacatttactatccaagaaaattattctaaacacattaaacaaccaaaccctagcttatatgtacgttatgcttttgaacagatacactcaggtgatatatggttagatctagataactagagaataaccctcttgaatttctgcaaaaaataataatttatgtattttttagagttaatttactttaaagtaggaatttagtcaactatcctaaacagtaaaactagacaattggatgtaggtactggacacttaaaatgacaattatatccttgacaagcaatttcaattctagttcaaaaaacttcgtccaaaaaacattaaaaaaaaacacaacttgtgagtaaagagagaagacggttaaacggaaggaggaaagaaaaatatccacgtcggagagagaagaaagctgggagaggagcttggggtggcgagagacaacgtcgtggcggagctgggcatcgaggaggcggatcgcttggtggagacgctcgacggtggaggcagaggatccggaagcgagtgccatccggaggcgagtgcggaggaaaaagaagtggagaggaatggagagacggtgggttcgaaggagtctagaggtgatgaaaaagatgatggttgtgggatgatacatgtaggggataggagtattagcgtcattagattttaaacatagttcgtaatagtgtcgaatggtagatcactaattaggaaatattgtttgtgtatacaatgcaaatgctctatctattatattaaaatcgaagtataaaataatacttgattattttaaatggttttttacggttttcattttaaaaaactaactttaacacttcttttgttatcttttctaattaatttgaaaaatttatcatacattatgaatcaaaacttacttatttaaagtgtttattacatattttacatttatttccacttttcttaactatttcattaattgtctttatcataatattttgataacatttagtttacatgtcaaccataataatttgacatgtttgaataaaattatttcatttgtgacaaaaattcaaaaaggttaacaaataatttttttattttcttaaagaaatagttaatcatgggtgttcggatgccagtttgggtatatatcgtttctttcgcgtatcaagttttttgggttcaaaattaggctctgatcacgtattataaatttttgggtgtatttcaagtcgtgttctcctatgtccagatggattcggttctgatgtataaaaactttaagatatccaaacaaccaaaagtgatttcatattacggttcaagtattttgtactaaaaataatcatattacgatttgagtatttttttattcaaactaaaaataatttaaaaataaccaaataactaaaagtaaccatattatctgattggatttgagtttaattctaatttgtaaaaactagttatccaaataatcattatacaattatttatacggtgacacatgtaaaatatataacgctatacatgaaaataaatatcaatttataaaagaggataaaaaccaacactagtcaacaattaaatagatgataagtaacagattttttttcaaaaacgaaatcgggtctcttgtttgagggacaattatttattcctctttattcctctttctccactttttttaatttttgtattttagtatgagaaacttgtaaaaagactgtatgtgattgttgtacccctaaaactttttctcagtatacttttttggctggctgtggagagaaccatttttctccatacgtttaatcaaataaatgttattgaaaatgtttatattaacaaatgcaaatgaaattagctcattgtacactactcttacttctacataatcgacacatataaacctcgatttaaaattcaatcatttgttcttccatctcctctcgaaactcaaactcttgttataatttacgtattaagtttttaataatccttccatatacgaatgagtcttaaactttcagctagacaagataatatgagtctgataagataatacctgtagtttatgatataacaattcgattcacggattctgccatctccacttgttttttttaaagctactgataaagtggaaacaaataaatgcccaataagaaaacagcagcatctagtccattactcattacaattcattgtcatttactgcttcgccacctgcagcattaagtactattacaggaataatcattcgtcacttcatcttgagatatttttatttcttggcttgtttagacagagtataattccactccgttttttattaaatggagtaaaagttaaaatagagtaaaaattaatttaactcaactttaaatctcattctataataaaatttatttcataaatagaataatttattttttgtttgttcatttagagtagggttgaaatatttttactttatttttacttttattctattttaaaagaaagaatagagtattgtattgtttttctccctcttcatctccttagccatatgaacaatctcatattttaaagttagtcactttaaaaagatactcggttacaatcattatcgccaagattattcgagaatatatgtttacaaaccactgaaccagcatctcctcgatcaacgagttgaatcgccgttacgcgagtacgtccgtatttgtatcccgtgggtattacgtgggctaagtgtccttgtataaacgcccattctagactcaacaaaaaaaggcccatatagttatccaatttcacaccattatttcggttgctaagccctttcaaagccccttccttcaacagcttttggttgctataagggacgccacgcgcgcattttgctttcataatcctgtaaataaggcatgcaaaagtctttggagaagagccaaggcttatgatatgttaggtttgctaaacaaattttgttattagcgattatgatcaacacattgtctaatttcagtttagttaatagtttttggtgccaatatctatggattttgttcaggtatgaggcatagacacggcataaacctacctgaagggcaaatgtgaagaatccctagaacaatggatacaacaaggtccttgaaagaagttgagaagacaagaaagaaatgttttttttttttttgcttttaacacagacaggaaatgtcttcgtatggggttttaatcaacttgaaggagtaaagatgaaaggaagatatttttttttgtatgggtgtgtatgttactaaaggacttttcgtagtggaaagcgggtataatttgcctcggtacggcttgaaatattttttgattaaacaaatgacatttcacctgcagagaaaataatattacatgcacccgcactatttaattctgtggatgactcgtgggattatcatgttttttttttgctaaactaaaggaaataatcgtgggattatcatgttatatcaatatttataaaaataatttagtaatatttataattcatttttacaaaaaaaaaaaaaatatttataattcaatatatatttttgaaagtttttagtttactgatgggcaagtatcataacttaaatccggccgtcctacacttgcctcgcataaaataaatcaacatgcacgcgcatttcaaatatttaaaattgtttgattcaaacatgctcagtggcaggtttaacctgcgggttttgagtcaattttccaactcttgtcgttaggtttgtctatctattatctttatttagatgactcttaaagtgttgttcatgagtgttcgtttctttatctagttggttcatttgttgtgatgaattgttttggttgaaaatatttttacatgaggttttaagcagcaaccaaaaattgatgtttggtggcccatcgtggcgacaaggtgataatcggcgtggttagatggcgaggaaatttattccttaataaactgcgtattgagaaaattggggcctaacggtaacattaaacattgaatgcaacactaactacagaataagtttgctaagcaaatttgtttaaaagcttcgcaaactttctattgattcgctgactcatctgggcgtatgctttacgtgatgcatacatatgtccttttttaatcgtccatgtagaacgcttacgcacagtttgctcaacttcctcacttcctctatgcatttcagcttttgctttctgttatgtaggaaccaatgtttcaagttagagttgagtgtggaaatttttaagatctaaagaaatctaacccacaagattactatttattttcactaccaaaaccaaaaataatatcttcctaacatatatatgctgacaacaaaaaaacgtctctctcgttgctagtcattctcatctctctcacgtttttttcttcggagaaaaaacaaggcggcacaaatagaggtgggaaagtttggtgatgcaaataaaattacacaaataatatgcgtttcttaagaagaaagtaaaacttgaaaatgacgtgacgtgacgtgacacatgtcatatattgtacggaactgacagtggaaccacgtcggggaccagtgctagggatggcgttttattacgctgttaagccacggtgttacgatattttgatggggccacgagctctgctcaattatataagagacccatcttttttttttgaaactaagaccaaccatctttcttgttttggaataaccgtttgggtttctattaagtttgcggtttgctaaaaacggttgtttcggttttatactcaacttttggaaacttcttatgacagttttttttataatgccaatgccagtgttgacactcgtccgaagagttacataaagctttatcagactaatagaattctctcactaatctgatttacttttgttttcttgattagaacatccgcaaaaaaactttataacttcaaatttgctctaaaaaaagtttcaaaattagtttaacaaacttcaaaaagaaacttcaaatttgctcttcaaaaagaaacaaccgtttagcaaaaactactatatagagtttttcctttctaaaaataaacttcaaattttgaaatttgaagtttttagaaatgaaactttatatttgaagtttcactactcaaaatttcaaatttgaggtttcatatttttatttacattttaaaataaagagaaacatttcttactttgaaattgatcatatacgagagccttatgaaaataattttatgaaataatatgatattttgctcgtattttaatatttaataatgtaattttatttataattttatatattagtgtaatatcttttaattaaaattgatgtaatatttttatatatgtgttagttatttataaaatatttctatatttaattaactttgacaaatataagaaccatattataaaatacaaataatttaaagttaaatttaaagttttaattttggaaaaaaacacatttaaactttcgatataaaatcttgcaaacttcaaaatagatagtctttttggagatactgttagcagttgatatgtattaagttttactctcctgctaacttgttattgtaaaattactccaaggaaaaggtttggttattgattcgatccgatatgtgaacccacgttttgtttacctggtttgtattaaaggaaacagtaccaaaactttaggttctcaatggtgataataaaacagttttagtaatataaacaataaggaatatgagtatactgtaatccaaccaagatttaggcgttacacccaataagtaaaattttcataaaataagcggtacggaataatggtgattagatatattttttggtacaaaataaatatttgattaaaagaatatcaaaattgttcgaacattcacgaaactcacataaattttatttttgtttgtttgatttggtttaggtaataataatagaaatatatattttgtttgaattaaaaatatgaaatagtaaatatctttcttagtgaactattctttcaaaagtatattatttttgtaaagatatttatatgtttttcaaatcaaagttatctaaatttatatataaattctaaattatttttaaataaaaatataatataatacatgtaagataatatatctttagttgtatttaatttaataatctgttttctctagtaatatagtaattagttttttttgttaattactctatatgctaaaatagagtataattgaaatatagtccaattctattataaaattatcttaaagaaaaaaaaatgaatgtgtcattggagatagaattaaggtatcattggtagagtatatatctagaaaagtttcctaccattattattatattgatatttaacagtaaccttttatatgttttaatcttaatcaaaaactagattatgacctggtattaaaaaatattttttttaaaaaattcattttactaattaatatgttttaacatttattttattgtatttgaaaatattattttgtatttattttatatatatgaaattatatatatatatatatatatattacttaattttgtttttcagttatctcaaccttattcgttatgatttttttaataaaacctctccaaattatttagataattatatgatatatattttgacatattttaagttatacaacttttttaatgtcaagttattgactttaatattttatttatatacaaattttaatttaatatgaaatatttttaaatttaaatgaatgtatttttatttattaaaatataaataaattaattcattgatttaatttatttcatgtataaaagaattattatttttaaaaaatatagttgtacttattttcaaaattttcttgaattatttgagtgttttaatcaattatttgatttactaaataattaaaaaacaatattaataaaaagttattaaaaaggtaagatataatttttttggtcacaaaatcaattagtatcttatttgaaaacaaatttattagtatgatgttattttccatagctatctttaacgaagttctaatgtttttttttttaagttttaatgtttttattaattactaataacattaaaaataatatattgtatgacgaaaaattagattcaaatgaatgtgtctattttaataagatagattatctaagaaacgacacatgacatgttggtgactttttaataagaagagattcttttatgtcatctctcatactttaaaaaataaaattattgtggttaagagattcaaagttttttacaccactgctgggtgtgctctttaagttgttgattaatgacgatgtctagagttttaattttacctcaaagaaaaggtttgggctgtggatttgatgtgatgtgaccccacgttttgtttatctggttcacgtttttgaaatccatcgatataacttataagcagcagcatgcatcgactgtagtctttagctgtcatcaagacgtttaccactcacggaagtgctcagagatcttttgctactcttttttctttgttcaacggatcttttgctaccaaaagagaaaaaatatcaaagcatagcaacttttgcaatttgaaaatgcacccaaattttctattatttaccaaagagcttcagagaattttttggctatttatggctccgaatggtaacagcggattgagcggtgcgagacaagcggtttgactgcagtgcagttctgacaattataaaaacgtatagatatatggtatatgtagagatttttgttactgtggactgcagtgcggtgcgggacgaatgttaccattcgaagcctatgaagcatccaaaaaaatttctgtacctaaatttgttgtctttcaaaataattttgggaaactcgtatattaaccatacaatagtcacctttgaactatacatgaaaatttcatacatatcaggacaaatcatggccttgtaagaacgagaattatacataatgaaacataaacaaattaaaattaacaactaacaactctacaaacataaaaaacattattcaaagtttaatataaaataacattgtttaaacttcaaaaaatattcataattgagcgtcaagtgcagttgtgaagacataaaaacatcaatattgaccaaataccaaaaatagttattaaagtaagtattttaattaattatttaagtaaaacataattattttaggcatatgataatatcatagtatactttggatacatattaaggattgagattgagtttggtataaatttttttttcggattttgaaattttcaagttttttttcggatatccattcgggttcatagtcgaatctggtaaaattcataacttgaaataccagagaacatgatccattcagtatttatattgggtttggatcggttcaaatttatttctatcgagtcgggtttgatttggattttcggattcagtttagttgtccaccactaattttctatctaaatttgaaatattttcaattattgaactgcctaataccttcactatttacaaaaggttttgaaacttatcgcctatacttgttgttctattcacacacacacaaaaaagcccggaatttttattttgttttctaactgtacttaacttttgatatttactattttaccaagaggtttccctataatttgtgctattcataatgatgcacataaatttttctatttattagataccccgtaatttttgctaaaagaagtaacaactgaagtgttccattccatatagtttctatatacaataatacccctgctctaaaattcatttaactcggctgcctagggggcgagtacacatgaatcggccaaccactgtggtgaatcaacataattggccatattactggagtattttcatttttgtttggattttttgttaaaactcaatgtactttagttacatttttactgtgaaaaattacgaaaagctgtacgaaattttttcagagtttgagcctaagttcaattggacgtaagtcactcagttaccacttagaccaaagagtttttttgtattagctacgcaaatacccttatataaatataaaaagttgaaaaactaatcccgactaatttctgattttttgataactcaccgaaactaatctcatgacttggtattcacaaaagatttataaacttttcacatttaccgagtcgcaacattgttacagatacactcgctgtcacaacaccaacaaaatatacaaaaaataaaggatgtcctataaaaaggaagaatccaaaaatccaaaaaaagtactgtattatacaaaaaccggaaataaaaaatctctgtattaataactccaaagggacacgtcggtatctccgtcaaagtcatagttatattcgaattgtacggacggtggcggcaaaagcatcccttcggccatgctagccaacaaggtcggcatcccgaacatggactcctcctcgtccatataaaacccatcgctgttttcctccgtaaaaatagcctccacgatcgtctcctccacgtccaagccatgatccttcgtcgtatcatttatctcagcctgaaaagccaccgcggcttcagcagccgccttctggatatccttggggcatgttgtctccgggatacggagccgccaagccgagtcggcgaaattgaggcaggcggatttgccacggagggctatggcggcgacgtcgtgagcacgagctgcgatctcggcggttaggaaagtaccgagccaaatcctagactttttgtttggctccctcacctcacacacccacttacctgagtttctcagacgtactcctctgtaaattgggtgacgcgtctcccgaaacttcttccgacccgcaggtttcttcggacagctcgcggccagcgtcggacaatactccccgcttaatgtaggagactcgtactcggagcccaacatttcagagaaggcagaaaatgaggtcattgttaactggataaggttgagtatagtaaggaactagaaagatctcggttctgatgggttgataaatgtttattttatctctcaggtggattctaaagtttgtagttcgataaaaagttgggagtgagagttggtgtttatattggcctctggaactagaggcgaacaaacatggagtttctggttcctggagtgacaagtgcgagtgtgtgacttgacacggctaagccatcccacggttagtgtatgcgctgtttttattcactaagaatctcacacgtgttctactgacccacaagaaatgacttttgagttttgactcttcattcgttattaagtatataaatttattaattttgaaaataatggacataaacaatctgcaaagaagatatttttagtgttctctttttgttttcttccttgatatttttaatgctctccctatgccttttttttgtcaataatctccatgattttatttttcattgatattgaatatcctgtctatgtgttttttcttgatacattacaaatatataaatttatcaatcgtggatctagaaattattttaactagaagcatatatatattaagataataaactatttaaataaactatttttataaaaataatataactatgtaatgttttttggacgaaatttattaaaataattataaaaaattagtttatagtattaaactatatttaaacttagtatctacaacatacacatacagtaatataatatcaaatcattcacacatcacagagtagaaaacgaatgattttatagtatattgaaaacaagagagttttctttcaaaacatttctatctttctctttctttttatgtcgtttcaatggaaaaaaaaactagatgaaatatttcgtttgaacttgccctagatcttttcatttatttttcaatatacaatacaaaatcacttattttcttttctcatgatactggtccaatagtaatttggagtaggtaaagaacaatttgtaaaatatacagttatgattagttctgttcaaataaaaacatagtattcgattgcgtttctcttatccagtcagatggttcttaaagtactaggtagtataatataataatataagttaatctaagatgaattgagcgaataattgagcgaaaataattgaccacaggattagaccgatagaaaagcaaaaaaaaacatcactctcatttgctaaaaaaaaacatcactctcaatctcaaaatatatcgataaaatatctgaaatcaaaataatatctttttcttttttttgaacacatcaaaataatatctatgaaaaaaatcgtggtctaaacctaaatcacgtggtgtgagtatttaaagccggacgatcgatcaaacttacaagattttatattcttactataaatccagaaagtagtttatattcctaagtataatggaaacaagaacttaaccaaaccaaaaaaaaactgaataatcttttttctgtaaactaaatacaaaactgtgtcaaattttatacatatctatttttttaaaaaatatccaaaatttagaagaattgaatcaaaaaccaagtggaatatcaaagattttattagtatagatatctttatcaacatgtatctaaaatttcttctaattaaattaataacaagggatgataaaaacatgggaaatggtgggaatgcaaccattatcatgagagtaactgagatcttattatggtaagtttaagaataggtataattataagattaatggtttattaagtagtgatataattatataagatttgaatggtacatgtgagaattatataacatgaagcaacattgttataatttacggtgtcgggtccagactcttccggcgtttaaagcagataaaaaaactgatgccccttaactatagtaaaattttactatattttaaatttataatcaaaataatgctaaatattattacaatttatgatatttttaaagaaataaaatgcaaaacatcaaaacattttgcagctcctctagactgtttttccttctcattgtgttcataaaatttcacaaaaattgtttatatatgggtttattcagttgaactcatcagagtattattatcatagtccaaccaccaagcatgaatcttgtgcattcttttcaaacttataatggtttatacaccatcttttatattatattatttcgaagctttttttaccgtaagtttttttctgactctacatctagcttattcagtttcggaatcaaaaagataaaaacgttttcttttctaaaatagtagtgttttttaaaccagaccggtctgatggttgaaccgggtttgaccatgaaccggttgcatagcagggttggaactaataattggtttgaccatgaatcggttacgtagccggattcgatctcaaagttattaaactgataaaaatcattaaaactatcaaaaatcaatataccattcatttaaacataaaacaagtttatatttttaatattttatcatatttcatttatatttttaattatgtatcatatttactaacattaattttaaacttatacactaaaacatagaaagattatagaaaacaaactattaaatttttttgacacacacaaaagaaaaggattataccaacatgttttattatttctggtatcattcataaggtgaaaacaaaaatcaaatataaccataatagttgtaaaatatactagttaaatacgttttaattataccaattataccgattgtaatagctatattcgttttagttgtactagttatattatttttttgtcataacaaccaatgaaaaattattgattgaagaagattatgagttaatatattttcgttgaattgtatttttttggtgaatcatgtttttgaaagtattataagatgaagaagatgaaaatagatttttttttgatttaatgtaaaaaatatccagaaatgaactggtttggtgatagatagcaaaaataaatttaacaatgtatcacctttcgttgacaaaaaaaaaaaaaacaatgaatcacctttctcatttaaaaataataaaaataataagaaatataagtattgtagaattttaataagccactacgggcacataagaatttgatcccacacctttgtgacaacgcctcggcgctctggaactttctcgtcgcaacattctcttgactggctcaagtttgacctcctgttaatcgtaagatctttttcatgaatacgattcctctagatttgttttcgtttcctttttgtttcttgattttgttgctacgaactcttagggtctgcgatgcttgtgctttgcgatagctctctatatctcttagattcttttcaagaaagttgatagcttcatagattaagtattagatctctgaaaaatttgcaactttggaataacagtgtttcggcttaaattgctgcacataagatgttcgacgatattcctctgagaagataactactagacatgcttttgttttccaagtttcggtttgattttactgaacagtaatcacatacgcatctctttatggatgagacccaccacatgtataaggaagtgaccattttattttggcaggttcactgtttcagtagccatggcaaagcatcaccctgatctgatcatgtgccggaaacaacccggcattgccatcggacgactgtgtgagaaatgcgacgggaaatgcgtggtgtgtgattcttacgtgcgtccctgcactctggtgcgtatttgcgacgaatgcaactacgggtcgttccaaggacggtgtactatttgcggaggggttgggatctcggatgcttactactgcaaagagtgtacgcagcaggagaaagacagagatggttgtcccaagattgtcaaccttgggagtgccaagacggatctcttctatgaacgtaagaagtatggattcaagaaacgatgaagatgtattggtttgcccgattgctggatctcttatgctatgtctgttgcatgataaaactaatatgtattgggtataaaaaacccatacattatgctttctttttcttgataatctagactttattggacttatcttagtgtctaaatagtctcttgcgttgtgtatcgtgtttgatttcatcacaccacagtagaagtaggcatgttcttggactcttaatcatgttttgattgaatacaaaattactaaactacatgtaccgctcaaatgcaatcatgttaaaacataataaattttagtttatccaaactgtgcgagtttaaataaataaaaatgttactaaatactcaatccgttccacaaagatcgatttttttagtatttttacgtatattaaaaaaatacattaaaccgtcataattagtgtatcattttcaaaaaaattaattgattttattgaattatcattggttaaaagttattaaaacataaaacaaattttttttctaaaaagtctatcatgacggatggagtaatcgaaaggactggtgtaacaaacaagagtgtttgaggaattgttgtgatcacttgattagcggatgcagtagtggttgactgatcattttcttatataaacttgggtctgtttcaaatgtaaatcgtgggtctatttatttgcagtggtttaaaaatgaaagatcatcgcatgaactaatttgatgattatgggctatctcttttttctaaacccagaaaagtttataagatagatgggcccaaagcctgttaagaatcgtattatattattttaaaaatagaagcaagaaaagaagaaagatgaaacttctccttcagctgatacagatcttctagacagagacatattcaaatgcttccaaagctcagggaaaattcctaaatcagattccatcactttgaccaaatactaagaagaagaaagatgttcttgatcaagaacctcagacgaatctcgccgacaacctcctcggccctgatcggcttccgaaacaccggatcaccccctctctcctcccgtttctgcaccactctgaatcaaccccaacaggtccagactccggctcccaatggattggatcggagccgttacgaaggtttggcaccgacgagagaaggagagaaaccgagagtggtggttctcgggtcgggctgggcgggttgtcgtttgatgaaagggatcgatacgagcatctacgacgtcgtttgcgtttcccctaggaaccacatggtcttcactcctctcctcgcttctacctgcgtaggcactctcgagttcaggtccgtcgctgagcctatctctcgtatccagcctgccatctcgagagagcccggctcgttcttcttcctcgctaattgctctcgccttgatgctgattctcatgaggtattattactgtgggaatcatctgaatctcagcatttgtaactgaaccggaaaattcgaattgaaccgatccataccgaaattgattttgtagggttgtatttgggatgtcccaaaaaaaaccaaacaggaaaacccaaaaaaactgaacctatataaatactctttttttaggaacacctatataaatgctttaaatattcaatcttataagttattttgatggattttgtaataatatccgaatccgaagtattattaatcaaacttgaaaaggttcagatcttagacaatgttataaaatttactagaatccgaagtattattaaccgaattatgatccaaacgtatattttttccgtttctaaaaaattcatattttaggattttcacatttattaagaaaatatatcaaattttagttacttatacattattttccgtaaccaactatttcccacaagttttcaccaatagaattttaataaatacaattatgttttttgaagtttacaatttacatttaatttatgcattgaaaatatgaaaatctatctttttgaaacaatttttttttctaaaacatggatattttaggaacggagagagtataaaaattcttctggaaccgaacccgaaagctcatgcacttttgatgaaaaatatctttgcacgctttcttaaatgtttgtcattggggataggttcactgtgagactttaactgatggcttgaacacattaaagccgtggaagttcaagatagcttatgacaagcttgtggtagcttgcggtgcagaggcctccacttttggaatccaaggagttctagaaaacgccatctttctccgtgaggttcaccatgctcaggagattcgcaggaagcttcttctaaacctcatgctctctgatactcctggtaagtgataaacaaataatgttatatttctcatgaagaatcaaaattattagcacagaacactttgttttaaattaggaatatcgaaagaggagaaacagaggctgctccattgcgttgtggttggaggtggaccaactggggtggagttcagcggtgaactcagtgacttcatcatgaaagatgttcgtcaacggtatgctcatgtgaaggacgatgttcatgttactttgatagaggtttgttttcaagaagctgcttcttcaggttcctccttatgtgtgtttcatcacttcacaattgtctctgttttatgtgattatttacaggccaaggatatactttcttcattcgatgatcgtctcagacgctatgctatcaagcagttgaacaaagtgagttcattaatggttttaaaaatcaatctaggcggcaaatcgtagtcgaaacattttttttttaaatccgattatacgattcaaaccagtataaaccattcttaatcggtttaaattgatttaaaatagtttaaatctgttaaattaaataatcatgttagtacagattcacaacttgtcttaatttttttgttttgtattatctaattttgataatacatcgaaataattatataattaaatccaaaaactaagtatcttatataaatataaaataaatcaataattcacttaatcattagttttctacattataccgcctagcgatttcttgtggttaatttataagacgtgaaatgtttctgtgctcattattatgctgcattcatatacattattagtctggagtgcggtttgtgcgtgggattgtgaaagatgtgaagccgcagaagctaatccttgacgatggcacagaagttccctacggactcttagtatggtccactggtgtaggtccttctccttttgttagttctcttgatcttccaaaagctcctggtggaaggttagctcatcaacatcactacattagacccttttttttttgcgaaaaatattccacatcggctaagactttttctatctttttgtccctgtatagaattggtattgaccaatggatgcgtgtaccttctgtacaagacgtgtttgccattggtgactgcagtggatatcttgagaccactggaaaaccaacccttcctgctcttgctcaggtaaactttttagatagataagcttcataatcgtctataccttctcatgccttgttatactacgttactgctcaattaaggtagctgagagagaaggcaaatacttggcgaatctactaaatgagattgggaaagccaatggaggacgagccaacagtgcaaaggagatagcacttggagttccttttgtgtataagcaccttggaagcatggcaacaatcggtagatacaaagccctagtggacctccgcgagagcaaggtaacaaatatttgactatgattcacctcgtaaaacaatgtggggttgagagagattacttgggcaggacgcaaaagggatatcaatgactggtttcgtgagctggttcatatggagatccgcttatctgactcgagtcatcagctggagaaaccgcttctatgttgctattaactggttcactactttcgtctttggccgtgacattagccgtatctgatgtgtccgaatccaccagtgtgttttgacctcggtttactttacacgtcgtcgttttttgtacaaaattacaataacacaatcttctgaagactgagaaggttttaaattatcctcttttttttttgttgttactaataatatctttggttgttgcgatttcgtttgaagaaaaaagaataattcagggttaaatatttttttcagggttaaacaataagtatctggaaaataattatcagttatggattagacagatgccctaaagagtttatatttaaagtttctattttgattgaattagaaaatattatttatagttttaatatgatatcttaaacaattttttgcatcaaagtaggatagttgctgttttaatttttaatgtaaaatcaagttggtctgcaagggaagacatccaagcgaccgcttaggacatataattttaaaagacatatttttatatatttatttttattcagaacttcgatagtgtttatatgtaaaaatatttataatatttttgataataataatatttgtaagaatttttaccctcgttaatagaactctcactaacaaataaattggaaaaatgtattgataaataatgattattttaaaatgtaaaattttgcgtgaaatatttatggtaatgttaactaatattgatgtgcagttaatttattaaaaatatgtttaccaattagtagttgaccaaattggtttatcaagttttaatgtgatttatatcatatagatatgatattagataaaacataaacatatatattatttgcagaaaggctaacctaaaaagaaaatggataaggatcatgatgactatcccaccatgcttgttgagatagtacctcttaagatattttgaatttcaatttatcaaatagatactttattgattgaaaatagcaatgttagtagcttaaggtatagtattaaagatcaaatgggctttgaatcattcggactacgtatgtccaatagaggtttatcggctctatacgctgaaatgaaaggactattatgacagtatcatgcatgagagacgagagggttcctttggtctggtttcaaatggattgctcagatttagtggatatgactacgagatcgatagactggctgttttttgctttggatattggtgtgtttcggagtttacatgatgattttgagagcatgagcatgtactttttagaaaaacgtctcatctaatccatatatggtctagtgatatgaatagctgataaaaaaaaagataaattgatttttaattttaatctttctggttctgaaccggattgtagatttatttatttatttattttagttgctttttctttttttccacaaatttttttattttaataccaaaaaatttaacatatctaatttgaaaacttttgtcaaaaaaatcttagggtatccaaagatgttagatcaacactatgtaaatttacacgatttatattaggtttgttttgtagatagattccctaaggctaaaacatcagaaaataaaggtaatatttagttgcccaaaaaaaaaggtaatgttaaatattggatcttatatattcacatgttcatgtcagttgccacgcatgctcatgtactactatgtgtgtgcttgcaattcaataaacaatgtcgtcgtatttaatatttctgaaaagtctttgtagtttgttattcttaaaactatataaaaagatgttttttttccaaatcgttttacacggaaacataatgcaaagtaatattattttaagaaaaggtctcatgtacagttaacgaaaggacaagatagggaataaagtgagaaaatacaataataaacaaagaaatgaatattgaaatattggtctataaaatctcaggacggctacggtgacaatgtctaaaactcatttggtctctcttatgtccaaatcagattttttttctctgaaagaaggtctaccaaatcaaacttcttctctaccgattgctaaacgactcacattcatcacgtacataactaatattttctctgtttcaaaaaaaagatgcatgttttataattcttatacatattaaaaaaaatatgaaattttgattactaatatagattaatttttgtaactaactatttctcctaatttttaatcaatagaattttaataaacacaattatatttttcaaagtttataatttatcattaattaatacattgaaaatataaaaaatacatttttagacaatttttttctaaaacatgaacttttttggaacagaagaaataattgtcttcgtaaatatctttttgcctaatcgttataaaactttaaatatataaatgggagaatatatcgtttagatccgataccaaaggggtttgtcaattatttacgaacgaaaatggcatgaaaatgcctatgtatttcaatcaaggcccttaaatcaactgttttctctcagcaaaagtaagaaaaaacgatttcaagactccagactcatgatgctatttgagaaaataattacctcttattcatctagttcatgtttttaatgcatatatgtaaaaagatgaaagtgaccaaatgtgccagcaaaaacaggactatgactttacctttcagctctattatttaaactttgcttatctttcccccaaccaactaagaaacctttgtctacttttttgtagacatttgcgcaagagtcagtgtgaacttattgattcggggaagcaaactcattactaaaggcatcattatcagtggatttctacagctgagtatttagacattcgtttattaatattttaaaataaaagaatttttataatcattctacagctgagtttatgaacattaacagtagatttctacagagaagtttgaaatagtcttgtatcagtgacaaaatgcctaatgaatttatggtttctcaatatctctaaagagtttctcagcaaaaagacaattctcattttttacttttatgatatttttaatacaaaaaactcatgaaagaaatgccaataaaacaaggggcaatttgttggataaccatagtaggaaaacaattaacaggtaataaaagaatataaactctgaaacgtttggttgattgaagcaatgtagtaaatctgaaacttatttggttgatccaaaccgaaacctgttctctctaatgggagtatgcgtcgttgtaagatattcaccgtgatcatttacaagttgacagaaacaaaaactttttcctagggaaaatattgatgaatcgaaaaaaggagaaagcctcgaacgagatgtcattgtttagggccaaataattaactggataattagagatttgttagaaagtaaagccattgcttctttaggaatagaagacaacgtgtttcgtcgtttacacgtgcacgtacaacatcccatctttctttttcttgtccaaagccatcactctttttttctgaacaactctttgaattgtttaatttacatctaattatcttcaaaaattggcttgattaatcacatgagattggtctaatggtatgtagactacagagagatccgggttcactaaacctgtataatcataaggatatggaccattgtttacaacccatttaaaatatgaaagaaaatcaatccatgacttccccttagaaaattaatatggactcttccataatagtatctttgaaaaatatatactctgttagatataaaccatacatataaatggtttgtgatgctgaagagacatgtattcatgaagtgatcgtgatctttaactgttctttttcttaatggttgtatctttaactgtgctttgtattgatagattagccacgtttttattcaacgcacacatattatgacgaatattaagggctttaatgtacgcctttcacctttggtggaccactaatccatgttaatgattttgttatgagaagtatagaagcaattcacttatgacaaattgacaatatagggtttcggaacttcggttccgcgcgaatctcctccaaaacaatgaaaaaaactcagtttgtatgggcctagctagaaacaatggtctctggtgctatgaattcgaacattctggtgctatgaattcgaacattcttttgaattcatatgatcctctacaaggtctgaaccaagctactctacggtccatgactggcttgcgcaactttagtgtagtccagggttttttttgtcgtggtgatgagtctatatgtggttggaaggttcatgcagtacaataaatctttgttttagcgagctgttgtatatgtggtacacgaaaagacatcattcttacgacgtgttctataccaactacattccctcaacacttgtattggtttgttcgtctgaatcaacaattgtgtcttttaaatgatttttatgattagttcaaaacccaaaatagttaactaacggggcaaaaatggtaacgaatagcttaactgattatattttcctttataaccctacacattagagatatttcagtgtaatatataagttactagataataacccgcgcattgtgcgggatgtgattattagttttcttatttttaataaaaagacattaaatctatttaatctagatattagttcggttttaagtttttttttggattttaatcttctaaaataaactattattttaaattaatattcattttagtttattcggttaaaatgtttgatttttttttatccggtaaaaaccaaaaattaatattatttatttattttcatgttatgaattttagatagtcgtcatgtcaaaccaatagattcatattattgtttctaaacagataatagttaagaaaattattaagacaaattatttcactacaatttggttggtagtgaaagaagcattaagaaaaaatattttaactttcaaaaaaaaattagatacttcagttgtggtgaatacttagttataaggtgctcacatcaaaatgcacatgtatgtgtatgtaaaagtatatataaatagttgacaaatatataaagatattgttagttaataataaatgacatttttttttcaaaacaatacatgaaagataaaattaaaattaatttaaaataaaaaggcattgacgttagtcatttttttatataaataaattaaaattggatccgtaaatagaggtggacacatatcgaatatctgggtatttggaaacattcgtgtcgattcgatctttagccacctagatattcggtgactcggatatccaaaatattttagaattttaaagaatatccgatttgatccgtaaataaaataaaattttaaaaataattttaataataaaattttattacaaaaataaaacattatttaactttttaaattatagtacctaatataataaatttaattcattaaaatattgtaaaactaatataaagtataatatataacgtatatatataattctgtacatatatgtatatatatgcatataacatagcaaattagatatttgttcctaaaaatattggtatttgtgatttgcttctttttggatattgtattttagtatttgatttatttcctagagttaagtatatccagattttttggttcaaatcaaaacggataacaaatcgaatcgaaatttatgaatattttgctcaattttatctgtaaacaataaaaataacatatatatatggtttggcttttgatttgttatctatttttattcgaaccgaaaaatctagagttttattgaaaccatgtatgtgagatttatgttaaaaaaaatgcaaaatacatagtgtgcacacatttatgaatatagtatgaacgcgttagtatatttattatcaaatcattgtgaggctgccacgtgtctattatagtgtgaatgtatttattacaatgcttctcttttaatatacaagggattttcattgtaatttgcaaatttataacaggcagcatattccccgggcctactcttcatattatttttggtgagtagcgtaatcatagatagttttcttaattcttgaacttgggtaacatcgtgggtatctacgaaatgattcctttcgacgtacacgatttatagataaacacgtagagacgtgtataataagcgagaaacttatttagcagtgttagagaaatatttgagttaacagactatagaacctttataaattagtattcaataaattaatatttttaatattcaataattaatattttaatcttcagtaaaaaaatataatattcgataacttagtattcaataaattaatattttcaataaattaatattcaaaaaattaacatttataaaaaatcattaaattatattgtctcattacaattgtaaattaataactgatgtataaaaattatataaacataacaaaatattgttatgtatggtttttatttaaaatgaaactaattctaattttttcaacacttcaaagtattttataattatatatttaaaaatattaacattatgtgattcatattatatatatgtcaaataatttaataaacactatgaaagctaagtttacaaaacttaattaatatataattcacgaaaaaatctattccttttattttacatataaacatattttaaaatatataaatctaagtatgatattttgataaattactaattttataaattaaatattatagttcattaagtattttgaataattattggatctttaagtattttgaataattattcaaaattgactcattttgttttttaagatttttaaaaaattgagtttttttttcgatttccgttagaatttgatttgggtaaaaactaaaatctgaaataccatagaataataaccatttggatacttatgtcgaattcaaaacagtttaattctcaggttcaaattttcatattgttttttcataccatagaataatagccatttggatacttatgtctaaaagtaatataatctgagacaaaatataaaaatataaggatttatatatttcaaccatatggatatggttgtgtgatacgaaagtgttagacattatcgatttgaaatctatcattcagatttgtcttttacatggttaaagggtgtgtgaatataaaactttcacgtagaacaacggatttatctgttgcctgaaaaacaggctaaacactctattatgattagtcttagatttaggacacccctggtccataaaaaaggtcttacatatttactttcgcatacatatttttctaatttaatttcactgaatagaacgatgtaacaaagtaacaaacccattgcatttaaaattacagcaaattatcctttttttaaatatataattatttctttaaatatatatatatttttttatttttttttcaacaaatatataattattaaaaaaaacagttttgagtatctcaatcaattctacagacttacacatcctccttcccctttatataaagaaacttcagacctcaaaatacatcgaaccctttcttcaccacattccacttcccacactctctttttttttgaattatagagagagaatcctcctccaaatctctctctctcccaggatggttgttgctatggaccaacgcaccaatgtgaacggagatgccggtgcccggaaggaagaagggtttgatccgagcgcacaaccgccgtttaagatcggggacataagggctgcgattcctaagcattgttgggtgaaaagtcctttgagatctatgagctacgtagccagagacatttgtgccgtcgcggctttggccattgccgccgtgtattttgatagctggttcctctgtcctctctattgggtcgcccaaggaacccttttctgggccatcttcgtcctcggccacgactggtaaagtttcttccattttgcattgcatcgatttattgaatgcacgttctacgagtattgtttgtcagttacttcgtaaaatgattcttttgatgttcattttttgaagatctaagattttttttttagattttctttttaaatcattgttccaccaccacctttcatcggtcgtacgactcgttacaacaccacatctttattttctataattactactgcttccgcattttatggatctctcaacttataattaaagtataatatcaagaatatctattatttttcttaaacaagaaagataatattgtttctttgttattttggtgtatttccaatctatttcgagatttagaaatgtgacacgtcattaccttgttgaagtgtttaaaacaaacatggaaagtttaaataaatagtgcaataaatgatatatatgtatatgatgaataatgatgtgaaatataattgaataatggcagtggacatgggagtttctcagacattcctctgctgaatagtgtggttggccatattcttcattccttcatcctcgttccttaccatggttggtaagtcagcttatcaaccctttttactatattattaattattaaacttgcatttgtatacttggtgcaagttggtaaatgtaatctgataactgaaaatctattcattgctcgttctattttttttttggctagagacaattttataattaaataatgcatgtgagaatatgactatttatgtgaggtagcttttcttattcctgtcgaaaagcatcaaatctttagcaacgaaggaaaaaggaatcaaattttttattaaatgcaatgggtctatgtcttggtcattagttttttgcatataatttatttatatttttttcttaacagcagctaatttaattataattaaatattcattttataaataatattagaccaattattaaaggttagatattttaagaattattcatgactttgtttattggaactccttttatcttttaatcttttctatttctccatttttaataatgagaaactgacttcaaatctccaataaagatggtcttatgtagtaacagtataattttttgtttggtaaatgtaacatcatcttcaaatatctttgaaaatagacttacatgcattattttgctgcgacattattgtcacttattcctggcaataaattagtttattactgaacttttttttggtcaatttattactagtaactttaaacttaaaagagtgagattgtttgatcaaaaaaaataaaaatagagtgagatagttagaatctgccatgaaagcaacactatatagacaatttaatttttatgaaaacacatttaataatttgaggctgcaggagaataagccatcggacacaccaccagaaccatggccatgttgaaaacgacgagtcttgggttccggtaacatttccctctttaataatttctatttttctgtcaaaataattagtttttcgaaatttgaggccagaacgaccacttgtcaaatttgatttttagctgtagtaaaaacagtttgctagtgtcacagttaaccggtaattgattctttttaacgatttatagaagtaacatttttgtaaaataaaatatacattatggtatgtgacaacggaccacgcttatttgtattggtgaatcttttaattactccctccaatttattttagttgcagatttagatttatgcacatagattaataaaaatattttgcacattttcaaaataaaaacaccattacttatacaactaaccatatttcaaccaataaaaataaattagaaaatattatttataaattttgtattgaaattataaaataatacttattttaaaacgaaattaatttacaacgacaattaaactgaaacggaaagaaattattaatacttaattaaagagtttttagaaaaattgaaagacatgtttatgcgaaactcatgtgaaagtctttgaaataatagattttggtataaatatttcaaattttcttaaaataataattatatattaatataatttgtgataaaatctcgtcaaaaactcactaatgcaaatgcttttattttgaatttcttactcctctaaatgcatttacttttatactaatattattttctttctctaatttggcgtttcgtaatagtttgtctgtattttgaaaactaacaaaaaataataaaaacaaaagcttataaacacatagcatgcaatgaatatgtacgaatatatataccaatacatatctaagtactatttttccaagtacttaatcttgattactaaaattcattttaattgttcctttcagttaccagaaaggttatacaagaatttaccccacagtactcggatgctcagatacactgtccctctgcccatgctcgcttacccgatctatctggtattttttaattcctaaaatttactacaagtcattttagactgtgttttaaaacaatataattatttttgtttggttttactgcagtggtacagaagtcctggaaaagaagggtcacattttaacccatacagtggtttatttgctccaagcgagagaaagcttattgcaacttcgactacttgctggtccataatgttggcaattcttatctgtctttccttcctcgttggtccagtcacagttctcaaagtatacggtgttccttacattgtaagtttcttagtatatcataaagggtatatatttattattcaatatatatactatatgatttgtttttgtcatatatttttgaaatattcagatctttgtgatgtggttggacgctgtcacttacttgcatcaccatggtcatgatgagaagttgccttggtacagaggcaaggtaattaaattaactattacaagtattttacaaaaaactaatgattagtatatttgattaatcttaattcttgatgttttgtgattaataataggaatggagttacttacgtggaggattaacaactattgatagagattacggaattttcaacaacattcatcacgacattggaactcacgtgatccatcatcttttcccacaaatccctcactatcacttggtcgatgctgtgagtcatctcactctctggctactttcatcaaaaccatttgattaaagggtgattaattactaatgtagtgattttaacaaatggaatgtgacagacaaaagcagctaaacatgtgttgggaagatactacagagaaccaaagacgtcaggagcaataccgatccacttggtggagagtttggtagcaagtattaagaaagatcattacgtcagtgacactggtgacattgtcttctacgagactgatccagatctctacgtttatgcttctgtcaaatcgaaaatcaattaaactttcttccccctttttgtttagcactattatgaataaaccagttttttttacttatatattgttgtttttaagttaaaaatgtactcgtgaaactcttcttaatttagatattattccatttacactgaaaaacatacaatttcaaaggttgaaaagaaagacaaaattttctagaatgaccctaaaatcccttttatcacaaatatagtcttcaaggatcaaaattaccaacatatttcattaaaaagtaaatagacacttatactcttagagttaaaaaatagcttcaaaaaatttttgaatttcaaaataaaattttgaaacaaaattcgaaaaatgtttcatgcacctatgtatatgtgtctgtgtctgtgccatcgttgtccaaatgtaagtttgcacgatcagtagtattcgtgacttgagcatctatgtcatgctctccattcccacatgattttagagagttatgtttcatgtcacagcgggggatctagagtttgcatgggttgattgcgggttcagaaccttcgtccagttcccctagctgcggtcaaagtagagttttctctttggaggaccatgtactctgcttcgagctgagttagtctctaagcactttattctagcggtttggaatttctttccatctgctattttaagttttgaacctctgaggtgactcttggattgcatgtagtggtattattgtttgccgtagctgagttcatctcttcaacttacttctccaaggcttcaagataagcttggaaaattgctcatgtattaatctatgtgactatgtctagcaatgtacgcacaatcggtataaaattttaatagtttattttttggtcaacaaatttttaatagtttttttgaccaaaatatttttaatggtttttaatatgtatttctaatggaaaaactgattaaaatggttttccaaaaacgtcaatgaaattattaattttgtaaataaaatataggattatataaattagcgttatgtgagtattgacttagtaataacaataatcaattataagtctaagctcaatgtgatgattttttttttttgcttgaaatgtaatgacgatgatgaaaaaaattcgcaatataaataaaaagttaatactttgtaatcataaatttatctttagaaaatttattgcattgtattaaagctttacattgttttgtctcttcataaaaaaattaccaaatttttttaagtaatcttataagaaaagaaaagtctgtaacaaatatacaaagctggattatttcaatatattatttgagaaatattacaatatttgagctatgtcatgtgtcattattagaatgctttttaaattatctagaaacataagttgatctatctaaacatatattatacttctcattagactaattatacaatcaaattaataatctacaattaatattttcattctttccttagaaaaaactacggaattacctaatgtgattcaaatatatatttgacaaataatgacttataataataagtatttgataacaatttgtctatcctcaatcattttgtttaattttatattattaaaataaagtaaacaatcacattaaccatataataaaatttagatttttagtatataaccacattaaaatgtgaccagtgatttaaatttcttgttataagaatatataaatgattataaaaccatatgagtgaaaatttcatttaataatcattcagatatatatctacatattaaactatataccatataaaataaataaatattttaatttcaattgcattgaagaagtattgaaaacttaaaattttaattgcaaaattttcattgaatttttataaattattaaaactattaaaaatcacacattgaaaatttgttagtattggttttgaaattttgctataagcatatataaataattataaaaatatataagtagaaagtctgatttaatagatagtcatattaaaatatatattatatatctatgttgttattatataaatttaattatatatcacataaaatagataaaagtgattgcttgaatttatttagcataaaattattctaaacaaataagagtaattgttttggtttatgtgtttgcgctggtttaaatatatatacaatagttaatggtttctcaattattcaatatatatatatattatttcataatatataaaaaataaaataaataataatatataaaaataatttgtatatacaataatcattctgtgaaggaattttaaactagtaaattatattacttcagtttgactttccttttcgaggtattaatagttgttgcttggtaaggaatgtcaaaagtcaaaactaatagtcagagtcaaaaacatatcatctccagtatagtatataatcaaaaaggatccatatatttaaagaatatttcaaatatatatatgaaaggttttagactcttcatattcataagaaaaaactaaaacaataaagacaaaaaaatcaaaatgatatcaataagaaaatgttattttttggcgttcttgtgtttggcgattctcttgactctaagtatgcaatatatgttgattattttgtttctatttgttattatattatatatcccttcatgtatgtagtgtaacatattatataggtttcggttaaagtatatacatttgtttgttataggataagtctttgagatattgaattgtacactaacaaaaaaatcatgttcttaaataactccctaatttctttttaaaaatatatgctcagatcttgcggaagctcaagataggagtaagctaattcctataggtccttgcgcacagattccgaactgcagtcagacatgcaaaaattcaggctttgctaaaggcggacaatgcatcaaatggtatcctaattctattaagtatacatgtgcgtgctttgtaaacgctgctacaccggctgtttaagataataactcttcaaatttgaactaaaaagatctcaaatgactatttaaatagaatattgaagaaatatgttttatgcaaataaaagtgcatttcaattttaattatgttctcaatgtggactgttatatgatcatatatatatatatatatatatattctgtatgaaataaaccgaattaataaagtttagaattgttgtcaagtttgcaatcataaattttcaattaataacaacgaattcaagatatgagttatctagttcacataactaacatgagccccccaaaaaaacatgagccacacatcttattgttttggttgttcgattctacaaaaatgaattttatttattaacaatataaacaatttaaatgaaattttttgtgaagtactgttttattaataagatacagaatttcagaaaaagataacaaataaaaataaataaaggtactgctaatcaatttataaaccataattatctaaacatgttgatctcctttattgttctgctcttaaccattccagaatttgtttgttatcctattttgtatagaaaaacattatttatcttaatacttgtataattaaaaaacaaacatttgattccttatataataaggtcaattatataatttggggtcatcgtcaatgtctacttcataaaatgatatgcgcctgattccaaaatttgaggaaaagtcttttatgtaaaattctttttattttttctaatgtgttaagtttatgttggatttgaaccaatcaattctagtgataaaattatacttgacagctaatctttcactctgaatatttttattaaaattttggaaagaaatagaactatgtatattattttaactctatcaaaaataaaagaagtctttcgtgcctccagaaaaattaatgtgttttatcacctacctaacaccttgtaacatagaactatgtatattattttaactctatcaaaaataaaagaagtctttcgtgcctccagacaaattaatgtgttttaacaccttgtaacacatactccatttgcgatatcgtaaaactaaagtacaaaaaaatttatgtagtgattgtaaggtcaatacactagtcttcctaaactcaaagataaattaatgtactgaccatcgccatgaaattgacccatatgccaagtgaacaggcgtgaaaaatccattagcttaactgccgatggtcggatattaaaaatttctttatcatatcccttatatattaattaagtaacattacaacattgttttgtagcaacgtgtcaccgtgaaaatgaaattcagaattcttatagaaatatgtaggttcatcttaacttatactatactttttactaaactagctattaaattaataaatagtgtacaaaagaatattttagtactttctttatataaaaactacagaattgtctaatatgattaacgtatatatgacaattaatgattatgaataatatatttttgataataatttttgtatcttagcttttttttctgtttaattttagattattaaaatatattaaacaatcacattaaccatatattaaaaaatatttttttatatgttatatttttaaatttttaaaacgactacaaattattaaaaacgttaaatgtctcacactaaaattttgtgatcaatggtttaacttttttggtaataacaagaaacaaatgatcataaatcgtatgaatatgaagtctcactcactagacattaatattatatattaaatatagcttaaaattatagtttaaaattaaactataaaacatagaaaaatacttaaatatgataatttctaaatttgtattgaaaaagtattgaaaccttcatattttaatattgaaatttgcattcaaaaattcgcacattaaaaattttgtgtttatcatatgattataaattctcaataataaatatttatattaaaatatactatatatttatatccatgtcattgaaatttagttatataccatataaaataaataaaattattgttttttaatttactaaaaaagtatcgtaaataaacaagatgtattgttttgatttatgtgcttaatctaatttaattatatatataatatgtaaatgaatataaataaataataatatatataatatttttatatataacattcattctgcgcaattgcgcgggtcttaagctagtatatatattaagtcagatgatagacaattgagaatctctcgacagttttgttctcaaaaggtgatcaaagtgatccaagaaattcggggaagatagttgatggtaaaaatggcagtgaaacctttaattggctctctcaatcaatgggtgtgagtgactctctcaatcaatggtgaaccagaatttctagaatcgcacaacaatcctaatccagtgatcaagagcaacaaatgaataactcaaataataaagacaagatacactctttgaagaaggaagcaatttcttttataaaactttttggttgattgaaagtgctttgtacaaggacgaccatgagcttaaatagactctgaagacaaagattgctaagccaaaatcaaatagagatcaaagaaaataaagggaaagagctgttggccttaaatggctttcttggccaaaaataagaaaggtgatgattattttgcgtcttgagagttttgtggagaaagcctagtgtcttgggacgaccatgtgaattgcaagtgtcttcataaggctgtggttgaagtgatatagccattggtcatcaaatggattccagcccaaccattagccgggggacaatatgataagaagccggccatacaattttcaaaggttgcagcattataagctgtaaccatggaggcaacaagagatggatatgttctgtatccaaaggtttaaaaatctgagcatgtgctggacgaagatggtgagtctatgattggtcataacttaaaccgacatagaccaaacttagtatatttattcaaccacattatggttcaatatgtttttccaaaaatttagtaaagttctgctttaaacgtaattgttgaaacttgcatcatgctacaacagtgtactgcttataaattacaaaactttgaaaaactagagagaaagagaagagaatagagaacgagacgacgcagacaaacatctttctgattctatctaccagtgaaacggagggaaggtttgtggaagaggtacagcctcattaccggatccatcagagactgcactcgcattctcaaacaaaccggacccataaaaaacagtctcttgggacaaagaaagtggtggctgtggctgaagcaaatgagaggaagatgatgacagaagagagagagcgcaatcagagtcatggatgcaactcgtcattctcgagctgtcctcttcttcttgcaagaaagggaactgtttccctctgctgtttggagaagaagatatcgggaacgtaatgcctgtctttgcaggaaaagaaccaacatagctctggttctgcccgtaacttgaaccattggccatagctacgcttacaggaccgcttccccagctcggactcacaacagatgtagttggaaacacgtgtggagagcttgaaaaatccagcaatttgctacctgttaacaagatggtgcttagggactcttaagtctattggatccaaaaaaaaaaagaatttattttttattttttaaaagaagaaaagcaaaaaccttggaagaaagttgcagtacgatcggtatggtcgggctgaggcttccgtcttcttcgattgtgtccatcaagacgtttcctacaacttttcttaccttcatcaaactcttccaaaccatgaaacctatctcaaaaacaaagtggaccatgagctaaatttttttgttttttggaattcatttctttaaataaaatatatatttttaaaaaattaggctttaatctaggctaaaataacacaaaaaaactgtagtatgtgcaaatgcaccctcagcaatatatacacagatgttaacattatccaacatatgaatacaatcagtttttacctgctgcattgttgacaaaacctctgattattgccattgattgtaaccacaggagttttagaatggacatcacagactttatgtcttttatgatactctctacagttactaaaatcagaatcacatccatcaaccagacaaatcgggatctggttgttccctcttgtcctcttggagcttcttgaagcctcagaggcgctctctttcaacttactaagacttatcactttctctgtcttgccaaaagcagaggaggaggaggaagaagaggagtttacaatgtttcttccaagtttcagatcaaatggtaaatttccttttggctgcaatcttcttggtggtgaggatgacccaccgaacgagatcgatgcatcgactggggttaaatccggtacagattcttggtcgaattcagagaaataaccggagctgagtttgaagttccaatccatttaaagcttttttccttctccttcttcactcactaaaagaagacatacatagaaacaaaaatatcaagatttatccttttggttttgttaatctaaattgacaggtttaagaaaaggatacaataaattcaactttcaaacatgaaattttttaactcgattaatcttgaattttgaagaatttttttttaaaaaaattaaaaaatcccaaaaatgggcaaacttactgtactgaaaaaacaaatgggaagtgcagatatatagaactagaacagatcccatgtaatgggaagaaagcaaaacaaaataaaaataaagcaaatatataaacttgcagttttgagtttcacttcatcataaaacccctctctcttttttatttatgtcactcacttgaaagcaagaatttaatgcaataaagagacagagattaaagaaagatgaaacatgttattcataaattataaaataagaaaagcttggtatttgaaggttgagaaatctgaccaaatccatgcacctaccaatggtcagtagaagaaactcaaaaaagagaagagcgaaatctacaaaatattgacaagtgagaaagagagttgatgggtttagcgagagaaagtggagacaacgagagtggctgctgctgcaataatgcacaagagaaagtgaagaaaaaagtaatatattactaagtttaaaaatgaagcttaatttaattgtttatttgctttcctaatataggaattgttgatatccttctttagagagagagagagagtggagcaaagggacagctgttattgttgtttgttcatttgctaacttttgcgtttttttaattaaaaaattctttattagtttgcttacgaaatttttaattttgtaacaagtttgttattattttaaaaatttatccttaattgataattattttattaaatacttcaaatttttgacaaaaaataaattaactcttttaaattatttataatgtttaaggatagtttataaaacatttataaaaatttataaacctaaatcttaaacaataattactaaaccataaattcaaatgttaaaatatttttattgaatataaaatttaaaaatgatagacaacttaatgtatataaccaatttttctttatcaatttgtttgccatccaacaagtctgaatttatgataattaaatgaaatgatatgaaaaatacacagcatcattagttaattttttatatattttatatgaaaaaacattaaacatgtaactcatcagtttatgttagtagtttggtatctaatttagacctgatatgttgttgagaaaagcaaattatactaaaattttaatatcgttgaaaatagtatagaatttaatgtgtatgattaaacaatatttgttcttcatggaactagaatttgaaaattttaagctgacatttacatttttcaaaactgaaaatcttccaaacataagttagagatgatagagcacaacctttttaaaaagtcataagattgtcgttagcctgaatttcacttggtgtgaacaataatttaattataccaactaattctgttaacgtcattatatccaattaaaattacaatcaatcaaactgtgacaaaaaaaaatcacaatcaatctaaatataaattgtataaagcatctgattatccaaaattttactctgtttttttactttagtatatttcaagttcatgtagatgtccaaactaatctctaaacgagtggtatggcttttttttttttttgacagcaagaaattcacagactcatgatgactctgtaaaccatgttggtaactccgcatccatgtgaacgaacgagtggtatgatctacaaatagactttcattctagctattcaaatggaccataaaataaatttatatttgtatagtcacaaagtaaagtgtagtggaatgccatcaactctatgttgattggcaattccaaagttcgcctacaagatttttattactaaactatcactttatggttaaaattttattttgttcccaataactatcaagatctttattttaatttgttatagtacatagcaatcgtttgcaatatatatagcatctatccaattttaatagctttcaaacatggtcaccttgtttctttgaaaataagaataagacagacagggttttctaatatgctcttgtaaataacaaaaaaaaaattggaaagtaataaataagaggtatatgatgcttatttgcttacggcaaaacatagcatgtgaacgtcgtggttcgcattacacaaacatcttcttctgtttttaactttttatcatctctttctttctttccccgatacgcgctatttcttcgaccaacatttactccttcacgggtcacaactcacaagtcgacaaataatatgtttttttgccaacaactaataaacatattttgtttccttttcttaaataacatgtcttgtcttcaaagaatcaaactagccttctacttcttctaaagagtatcatcactttaacacttttcatatagattaaaatattaaaatatattactatttttattaattaaatctatttaaccactagtatttgagataaataaaactatttgtagaatcaatatattttataattaatattaaacttcaaataagtataaattgctttaaaatataaatgtcaatctttgtgtaacaaaaaagtatcaaatgatactatttgtaaaacagagaaataattagaaatggctgattaacaccctcgttaaaaatttctccaaaatcaatttatttttgaagaataagttagttgtagaaataaaaataaaaaatttagttgcatgtttgactatttaaatatattgatttatcttgaattcggatgttgcaactaagcgatggatgttgaatcaagtacatacatactggattacatcaaatgtgttatatcaaattgttgtggatgttacacctgatagtgagtttagttccatgaggttgtatgtactaaagtattaagatgcatgatactggtgtatatatattttgtattcaaaataacttttattttgtactcgataagcttaatatcgcctataataataaaatctcactttctctgtggacgtatccaaattggaccacgttaaacctttttgtctttgttacatcgctttatccatctgtttttgcatatgttcattttcatgtatgtaacaacaaaagtggcatcacagcttcgggtctatgatttggtgagaagatggctggtataaatgcgaagatagaaaagtttgatgggagaaataatttcaatctctagtattgcaaacgtttccgaaacaccatggcatatgcgggccgctgtcaggaaagaagtctaatgttgctgttttagatacttaggaagaaaaggcattctctaaattttggttgtgtttaacagatgagttcatcatcgaagtatcggatgagaaaactgttgctagtttgtgacagaagttagagagtttgtaaacaagttacttctaaagcaacgcctctttgccttgcatatgcaaaaatatatatattgagatttgcgaccatcctggcaagttaaatttgatactactagagatgtgtaacatcgatgttaaggtggaggatgaagacactacagtaatcatgttggtatctatgtcgaacttatttgaaaatttcgtgcaatcgttcattattggcaaagatacaatgaaactggaaaaagttagatcatcgcttcatagtcaaaaattttattagaacaatccagttaaaaacccaaaataaaaataatttaggtattttctttatatatcccaaaagaagaggagtaaagaaaaatatttacctttgaaaatctttataagatattacttaaagagatttgaaatgtataaaagaaataatggctatgagagttgaaaagaatccgcaatatctgctagttaagccctctagtacaccaagatttagttttaaacaattcaaggaatataatgttaaagtttatggtattatttttagaagtgacttgaatttaaagccttgtaaattaagatctttgtagaactaacttgaatataaattcttgtaaagaaagttttctggagatcgtcaggcctcaaaactcagatctaaccactaaatgagtaaatgtacagccataagtgaattttggcccttttagggacgactttgtttgtgttcagaaaaaatagactggatggctttttttttagatcaccagtgtgatgatttgtttggcatttttattttagatcaccagtgtgatgatttgagaataagtgatgcatatggtgagaaagtatggcatacttataaaaagaaacaaaccgagcataacaatttaaactggtaatatattaaaaataatatttttgacgtcagactgaacttttcacataggttcaagcagacggctcataagaaatgaaattacaatcatatcatcaacttgtaaacgcatttttccgtaaattaaataggagagaaagacagaagtaaagcatcaaatattagagactgaaggaaccaacactaaagcctctttgtgtcccgtgcattctctttttagtcactcagtctggtgtcgttcctgtattccaaacaccaaattaaaaaaaaagaccgtcaatatatatacaatagtgtttctttttgtttcacatgtagtattacaaacctagacaaccattctagtactttttgcaaagaaaaaaaatctcattatgaaggaaagttaatagttttcattggtataattatttattttccctttatgcaaatgcaacctatggtgcttttgtttccctgaatttgacatcattttttgaatcaagattatagtgatagattgttgctccgctgcacttgaaccaaatccgttttgatcacactttagatccagttcgtttgaaccttaagtattaaaaaccggttatcattttggcacgttacatgcctagtagactcttttttttttaatgaaaggcccttgcacttacatagtgaagctcaaacaaatccggaaaaatgaccaaaccatattcgaaggatgataactcagctatcatgtggaccaacctatttaggactaggtttgccctcacaaagattttcatcaccaccataaattttcaaatcaagtggatatgctatatgagttcaagatatatatttacgttatagtaacctataggaagataggaaaatggttaaagatgaaatagttgaccttaggtttgaggatgccatacttcctaaactgttccctcacgactctgttgtatatgaaagctgctcctctgaattgcggcaaaaccaaccatgctaccaacactagcttcgccgtgtaccatatcggtatcctatatacattttcacacaaaaattcaatttttgtttctcacattatttccaggacaaataaaaatacatagttagtattattgttaccactctaggagcgattgaaggatgagttctgagagagttaagaaagagtagataatccaataagcaagccattgctcatcatctgcttttgatgggctctctattgctagcaccgacgcatatcttaccaatattataaatataaaaaaaacaatttgaatttaatcattgaaataaaacgaaacaaaatgtgaatttatcaaagaaacaatagtaagttacttacaacggataaagcagcatcaccacaggactgcatatggtcgtaaaaagtaaacaaaacacgaaatcacgttgttattttaataataaaaatgctattataaaagaaaaacaattcagccataaattgatggagataagtattaaatcgagaaaataatatgaaaagtcaagtaagtacccagcgatggaatgaagagcagagaggaaagtccaaagcttagtcattgtaagaggaacacaaaaaaaatccaaaccaatcaaaggaagaataaaagagaagtttcgaaacccttttgttttctaaccaacacgcccaaagatggaaggagatcttcttatttataatatcaaacttagacattaaaacagtttggcacgtggttcagcccctggtttaagccgggacaactatatttcaatattttggataccaaaccgatgaaaaaagttttgtgagagcatctacaataatgaaataacaccaaatttgttattttgatgttaaaatagttaccatctctaacaatgacaccaaattttacaccaaaaataatattatatattattaatattttaaattttaaatttttttttattatttataattaataaatatctagaatattatttatatttttgttatttttaagtgataaatgataatagtcatttaattatttattttgaaaaaaattaattttttaattatgcgaaaataaatttaaaatacaaataatacaatatatttatgtctaattacaaattttatagtaattaaattatattatttattggtgtgctttacatcaaatttggtgagtgttaattttagtattttattgaagatcaaattacaccaaatttgatggtttagtgagacggccttattcatataactaggcgatcaaaatcgagtttattagtccggtttacatattttggtggcttaagtttcaatgagttaccggacacgtgggctgaagagacaagaggtatcagattctaacttgagcgtgtccgacatgtcaccggccaatagagtcccgatgtcggtgggattctctttattgttattttccatgctttccctactatattgatttatcattaattacacatacaaatatttttgttgtagcaacactcgtaaaaatagtttaatatgctataatatttagaaaaatatctgatatatgctaaacacttttgttagaaattatatacaaaattttttcatatacttctttcattttcttttgaaagtattaaatatttttatcaactagatacatggaagaaagacacatgaaaccatatatctgtaaacacatttgagatatacaataccgtaaaaaagacaaaaattattgaagatacaaatatgcttttcaaatgaatgaatgttaataaatatattttgaaaaacatgttgaaactgtatctaaacgataagccttttctcaaaaaaaaaaaactgtaactaaacgaatgaaaattatattttggaaaaggtgatcgatctttgagagcatcccatgatgatgtgatagaaaaaatttcttgggaattcgtaaactcaatgatgtatgactaacctccaggttttctctatgtttactagttgatatcaacgatcagaaaccatcaccgcaagatgtattcgcaaccgtaaaaccaaacaattttttaatagaatgtaacactcaaatatctctttaatagacaaagcactgcgatgagttgcataagttgtttggaaaatgtgttgagggttttgcagtggaaagctcaaaatttgtgtatattagttacgaacttccacacattaaactacatgcaaaacagcaaaagtattttttttttggaacaaaaaagcaaaatccatacatctcaaatggaggaagcagcgagataagttgcaaaaaaaaaaactgtttgagagtgttttgaaagttttgcaagaaagcacaaagatagtatataatgtattaggacattttaaacatgacgtagtatttacttttactatttagagatgaagacttttagaaacatgtaagtgcatttatattgagtttgtatcaagagtgcttcaacaatgagttcctaagaaagttcaaatgaataagtcgtaaaaattgggtattcttgttttcaagtcagttgtgcgagtgaaacgaattcgtgagattaagccatcaatataatttcgtattattggagatcgatttcgaggctcaaatctctgcatggagaattttttatgttacaatactaacaataacatgatcatctaataagcttgaaataagaaagaatccatttaacgacataaatagagtaaaaattctaacttcttaagcaaacgatttactacatcatggtacaagcgttggggttctcgtcactgaatatctgtggtggataagcaaacatctccacaggatacctcggtggctggtattgatattcattcttctttaaatccaccactttgtcatctccctccgctgcagcacctccatctccggccgccgatttggccactccaccaccgtcttccttagcctctttgctttctttgggttgttcttcttcctttttcttctcgtctttgtcttttgtttctttttctttctccggtggttttggcgatggatcttgcttgacaatcgcagcatgcttcccgattttcttgttaacgtactcaactagcttttccggtataaaaactcctttcacgctcacttgtgatgctttaaagtctggttccacagactccactcctgtatagtaaaaggtagttgctttatttttttttaataatacaatattcaaggaattaataatcgaagaaagtcgaactttcaaattgcattacaaatatcgaatgcgcaaaactaatttcaattcttaagcaaccaatgctattctttggcccttagaactcgattagttgatagcatttatgtgtatatatctatcaagcataaaaatatccacactttctagaaacaacaatttgtacaacttatagttagcatatacacatacgtactggaattttagataactccgcatacgaggaatgtattcactaactaactaaaaaagtgtttagaactttgagatccttgggaaatataataggtgaagtaaatacaaagcacttgactttagttgactctattcaaacccactacagtttcatgtaaccttgaaatactaaaagaaacaaaaaaaaaatattcgggacaattttgttaaaatatatgattatagtaacaaataatctggtgaatgagtttctttttaaaggaggaaatgctctaacggtctaaacgcatggtcttgtatattgctctttttaaagggcctacatagtacacacaattttaaagatggaatcaacttatgacatacataagagtccaaaacgtaatgtcccaattaagtgaagtcagagaaaacttcgatttaataggagtcatacccagttgaggatattataattaaaattttgaataagaagatgaaaaagaaaacaaacctttcattctcatgattctcttttggatctccatggcacatgcttcacaatgcatgtgaactctcaacaccactgtcactacctgtttttctcagtgcccacaaaattttaatgttaattacacaaaaccaacttactttcttcaaattacaaatctatcctcaaaagtcttaacctcttcttttttttcttgaggttttggtttctcctcttttttctccggttcatctgaaaccggtttaggctctgggataggagaaaggagctccactggacggtggctctttctttgcagtctctgcaacacttttagtggatctgccttctctcctttcaccacaactttactatttttacaatcagttgttacatcctccacccctaatcacattttcaattatcccaaaattaactaaaccattacacaaatggatatgaaagaaatgtgtttagttgtaccttcaaagcctttaagacatctatggatttttttagcacaaccttcacaatgcataaagatcttaagaacaatctcttgtggctctttcttcttctcttcttctttcttatcatctggttttttcacttgtggctcttcagcttttttctccattttctcttctgatttcttcttatcttcctgaaaatggtaaaaaaggagaaaaaaagtttaggaatagtgtttggatttgtgaatctgaaagtttgaaatacaaacctctcccattgattttagtgccagtgttgactgttgagacttgagagagttttttagtggctcacttatttaagttttttcctcttctttctacggacttgagagagatctggttatataaaagacacatactatttcttttatttcttttttttcaccccacaaccacaagtacagagacttattagtatttttcccatccaattattcatagattttgaagatcttttataaaatgtttcttctcagtgttttgttttaactgatttttttctcagtgtttttagctattttgtatatttgaccaatattgggtactctctaatcgtatattcgtattgtttccaaaatttgaatacagttttaaaccttatctaccataactcaaaccttatcggttgaagtaattaatcggcttgattgtcaacatattaagtcttctacaaaaaataattgcattactattcggcagaacctacatatctaactgaaatatactctttatgttttacaaagatatcactctgacattttttttaattaaacttctaatactccacatgttttaagacgatccatgttttagaaaaatgtgtttcaaaaataaatttttacatttttaatccatattttatcacataataattgttaattataaaattcaaaaaaataattgtgattatttaatttatgctgacttaaaattgtgtcaaatagataatcacaattaatacattttcataaaaaattatgttttcttaatatatataaaaaaattaaacataaataattgtgaaacggatagaatattattttagtgaaatgacattatgaaatcagtcaatatgtctctttcttggaaaaccccaataaatctagtatttattatcatttaatattgctgatatttaatactccctctgttttttaaagatggatgttttaggaaaatattttgtttctaaaagatgtatttttcatgttttcaaagcatattttgtcaattaataatgaaaaattgtgtgtttcaaaaatattaattacatttcttttaatcctattggtttaaaaatataggaaatataaagttacaaaaaactatgcattaataactaagttttaatatggtttcttaataagtgtgaaaatcctagaacattcatctttaaaaaacagagggagtatttaaaattattttgattgttttattacattattttcttttttaactagttattatcatttattttcagctaactttttattatctatacaaataaatattcctcttagttataaattcagattaaataattttatacaatcttttcaaaaataaaattttcttttggaaatctattctatcaggttgcatatgcacattttattgtaaaaacaaaagcacttatttcacccaaaatatttttagaattttctttgtatagttttatatatatttcataataaaactttaagaatgttttgttagtgtattttcattcattcattcattgtcttgtttacttgacaaaccacaaagagttatgactaattaattttcagaaaatattcaaagtttttcagactgaaataattgtttccaacaaaatatgataataataataataatgtagttttattaataattataacaaagtttaacactaaatgtttttacgttaaaatataacgaaggtcacactattttcttgctttaagccacaaaaaatactgtctggcatgctttttttttccttattgctagacttttgttgatgatgtagacttcattaatgtttgattcaagtcacgactactaaggctatgtacaataggtggctttattcaacaccataatttacgcttacacatcatcttttatttcatccacctattagtttaatattttcttatttttatatttacgataatttatttaataaaatacaacactataatccaccattttatctcatattttcctttttataattatattttgtaagcaaaaaattgaaaaatattttttttaaactataataactaaaacttaataaattgtaaatttttaataaaaaatatttatgttccacttaatataaaagattaaaaatagacttttatatatcaaaataaaaaaacctaatctttatttaaggaacacaaaaataataaattttaatataatttatttctacaaaaatattatttgatataaaataattaatctcaagttattaggatgtaacaaccaataaaatagttatacatatatcaatatataatcttttattttttaaaagaaatttgcttatattcatattcgattatgttttttcccgaacgtagtttaaagtgaagcaaaaccaacatagtggatcttacataaaatactttcaacatgtagaaaatattcaacaacaaataatccacctcatttttttaggttttcaacagatccattgcaggtattcaatagttgaaagtaaaattcaacaaacccattgcatatggtataatagtgacatttgtatacaatggtgcgtgtatattgtatatatatgaaatttgttggcccagtgcgtttgtaaagtattctacataatttaatatatataggaaatttgaagcacatacaaaatgtgatttgaagaaagagttcataatgctagacgttaacggctttataattgagcatgaaagtcttgtgagtacactatttgaaacctagtcagcgtacatgattatgggtgtgattgtaagtcatgtctagagtaaatattgaagaaaaaatatcagttattcttatttattctgaaatcttatcaatcaggtaaaaacacttttcttcctcctacctctaattgctatttacaagagaataaaacacgttaatagttttactccaattcaaacaagagtaaatgtgtttacctagtttattctctctctcatttttttcttttcattttcatcttttttcttttcctcttatttactttatattttgatattttccatccatgctctatatgtgacaacggtttaaacgttatattccttacgaatattttttttggtaaaaatgaatgatttatttcatatagtactatacattagatcaaatttaccccgtcaaaaaaataatttttctaagaataattgcagttaatatttggcagacctttcatatttaactgacatataccctttatgttttataaattttatcattttgatattctttttaatatacaaataacgccactttaaatttttaatacaatttatactcattttaaaatattaattattaaaaattttgatttataaaaaaatttattcatctgaaagattattaattaaacaaatgtaattactaaaaatatatgcattttaatcatttcattatttatgtaaaatgttaaaataatattttcatgaaatgaaaggaacataattgtctttttctttggattttccaaaatgtccggcggaccgagactcaaccgactaatccatgagatatatttaccggcgttaaatagatctgattgttcacagtggacagtagatacttctgttgcatgaccacacaaacgacatatctaaaatggtgagtttaaatatgaaatgcttactattttccaagtccccgtaccattcaactacggttgtgttaatataattgttttgcaaatggcagaacagaaaactagatgtaaattcacaatgcaaggggcaatgcgatgatagatggtattctttcgatgtccgaataagccataatgtaactactgtctccttaagaagattagaaaaatcttaaatgagtaaaatccatgaattctactttaacacttttaactggagaaaactctattaaaaacaacgaagctacatgagatttactttattttaacatgcatagccgacatctcgaatatttctggagcggtaaataaggcattcttgcctacgccaatctcctgtatattatttgagaagaattgtaacatttttttgtagccagatgtcatcactataatgatttttagaattcttagaaaaatacgttggttcatctaaatatataataagccttttattaaaccacaataaatacattattaatgtcattcattatttccttaaataagattacagaattatctaatgtgactagagtatataagacaattaataattttgaataataaagatttgataaaaataagtgtgtattctaattatatttgtttaattttaagttattaaaataaattaaacaatcatagtaaccatataataaaaatttaaaaaattatttatatattatattttgaatttttaaaaacgagtataaattactaaaactgttaaaagtttcacattcaaattttgtgatctatgatttaaaatttttgttatgacatgatacaaataattaaaaaataatataggttgaaagtctcatttaataagtatcaaaaataaaagatatagaaatatatgtaacattttaaatttaactatatgtcatataaaaatacataaatatcttaattttaaaatttactttcaacatttttttgataaaaaatttgaaaaaatattgacaatttaattttttaaaatattataaattatttaaaacattaatcccacagtgaaaattttggtatcactaatttagactttttgctataacagatacaaatgataaaaaaaatgagcaaaaatcatcatctaataaatattaatattaaaatatatcatatatatgttactatcatttaaatttaattatatatcatatcaaatagaaaaaatattttttcgatttataagatttatttatatgttcacaccaatttaattatataagtagtacataatgacattttaattattcaatatatatttattatttcataatatgttataaacatataatatataaattaatttatatatataatgttcatcccgcgcaaggcgcgggtcttaacctagttaacaagataaaaggcatatatttacttcttttttacagataacagaaacagactaatagtaaaacaaaaaatcataaataaaataaaatacaaaattacacaaatttaaaaaaaaattggaaaagtacttccgtttattttttactttaaaaatatcattgtttttcatttgtagtactctcagataaatgtaatgtacataaatccagtgtacattctgcatattagattaaacaatttttgtttaacttcgtttaagactagcgccattgcgcggattaatgttagcaagaccgctttggacgcaagggagtacaaggaagaccggttaaagcaaagcgattaacacgttcgtgaacctaaagaaagagcacaagtgagttcattggcaagaagatatggttcctttcttccggaacgtttgtctctccaaaaaaccctacaccggtgctagtcctaagatattttaggtctaataggaaattaaaaatataaactctaaaaaattaaaatttgataaaaattaattttacgattaaaaattaaaaattcttcaaaagtatacatagctaccagatttaaaagttattttcgttttctttttatgtaaataagaaactaaacttcaaaaattattttgttaaatgtttgaaatatattttagatccaacttttatatttttctactaacaacaataacaaaattaagccttaaaagctttaaaaattatgggccgcatacccatgttttttagttataggctcaggaccggcctgccaccactagatgctatatggagttgtccaagatgacaaaacagcttgctaaagttgatcctttgagaaattggctgatgcaatgatcgcttggactgaggcgtgggaggagcttaacccttcagttggtggaaaagatgtcacggccaagtgatgaaaaattgacgattataagtgatgcctgttattgctgcatgaataaggtttgttattgttgtgatcttctatttatatatctcattctggaagtgtgcttcgtacaataacgtaatactgtgtgttattgttgacgttaacgttgctcgacatgtatttaagccttattggtgaaatgatgtgtgctactttaaattacatggatgaaatgattgttttaacaggaaagtaccagaggacttgataccatcctatatccaagtaatcgcttgtccgggacgtcgaaatactcgtttatgttggcctccgacaagcttctaagccttgattatttcattgataatgatataaatgttgtaatttacaaaattatgcttagagattttttaaaatattacttgtgatcagttttaaaactaaattaggtttgattacgaaaattaagagaaaacattaattttgtgactgagagcatctctaaccccactctatttttcactctaaaatagagtttagagtaaataatgctccaatggtactctatttctcactctataatagagtaataaataggtttactccaaatatagagtaatttgtttttttattgttcatcactttattttctactctaaaatagagtaccattggatcaaactcaaactctattatagagttactctattttatagtaaaaaatagagtaaaccattggagatgatctgagatggaagacttcatgtgatccaatggtcaagaatcaaccacttaaggaggcatgtgtctttaactaaagagttttgtttgtttgtcaggtttaggtggcactaaattggtggatatttgcctcatcatgcatgacatccttagagcatgattagtgaaggagatccatttgggattcttaaactatgatttgacatttttctgctaaaaatatttttattatttttattaattttttttttaatatttcttagttaaaaactaaaagatatatatttttgcttgtagcctcaaaataatctcggagaaaacatagctattttcgaattaatgacatatcgtgaaatacaaaacgtgcctaaccatttcaaattcattattaagaaaaccacgaaatatttactaaaaatgtgacaaaagcagacatgattttggtcacgaaatattcctatagcaattaggttagtcatattcatatagcttctaagaaatatggcacaattgtgattaaaatgaattcatggcaactatgagtgttactggccatagaaaatgctttgacattttttttttggctaactaaaatgctttgagttctaaatactgaatatggcaactcacaaagatcatttttcacttctatttatgaacaaatgcttgagacattatctaaccacccttactattatttttcaagtggttattcaagtttctttcaaattctcatccttctagatgacaacaataagaagatgatattcatttgtccttatagcacttatacttaccgtagaatatgatttggcttgtgaaatgcaccaacatacgatgtttatttttacttatccgattgaagatataatggaagttttcaaggaagatattttcgtctataagaacaacttttatgtctatttatcaaatttatgcaggatgttccaacgctgtgaaaaaaaaacattttctgctaaatcggaggaaatgcactttcacggtgagagatagaatcgtgctgagacatcagacttcaaaaaatgactgaggtgaacaagacaaaaatcaaggttatgagaactctatgaccaacgaattctattatagccgacgaattttattaaagagatttagaggttttttgggacatggtttctttcatcaaggatttctttaagatcgcaagacctttcacccagctgttgtgcaagaattgtttttctgaatttaagagtacttttttttataaatgcaagttatatgtatttattttttaaaataaattttacaacattaatggttgttttcctaaatttgataaatatattatacatatttagaaatatatatcttcataaattttagaaaatgttatatattcaatattatttttctaaaaaatattggtcaaattcaagaagattttatacacattcatgaagatttttcctagaaaatgttatacatattcaaaaatattttactaaatatacatctaattcaaatttattaaattattcttatatattcatgaaaattttcttacacacatttgagaattatttataaatacatatttgagtttacctaaattttatgaagatattatatatatgtattaatatatttttcagtaatacttttataaatatgcatataactcaaattcaggatatcatatatatttaggaatgtcttcctaagctttttaataaaaaagatttttcaaaaaataaaaaaaaataaaaatcatttttttaaatatcatctttgagaaaattcatttaaatatttatttattttatatatctaaaaaatattgtcatttacctcattaatgaatgctaacttggtcattttaccgttataggatctttttttttggtaggaccgttataggatcatttgagatttgtatttaagaccatttgaaaccatttttcaaactaaaatatattatacatattttatattatgcaacataaatattttaataaactttctatttttttttgcgtatgacacgagtcattacttaattatatattataaattaggtattagaataccacataaatttggttgcggggcgcacatttagtaccggatattcctttttctcaaaagtatttaataataccaaacatagcaagttgctttaaacatagcaagtcgcaagtagaaaatttcctttttacaaacatcagcggtagttagccagtgacggacgggtgtgtcgaacaatatacaaaaaaaacccggaacattagaatacaaatttgataaaaacaaacttccaaacaaagtttatcaatgatctatcgaatatcacaattcacagcaaaatgatatcctaacctctttgaaatgtatttgtttgtaacttgtcattctattatccattaagacaatgatttttggtttttggaataattccgcttttcatgttttaagtatattttatatcagtgatttgtgatatataaaaatgtctatctgtgatagaaatatttaataatttataatagttacatttgttaacaattgttaagagtttccattaagtaaatttattgtcttatagtgatcatttttggctcaacaaactaattaattttaaaacagaactacaaaattatcaaaataaaaattattgcatagatattaattacatgcgccgaatagtaaggtggatacaactttaaaagaattagacccaaaaaaaaactttaaaagaaaaaaatggtggatacaacttttgtggatacaacaaacaaagttcgcatatgctttttacaaatgttcgtcaattcatatgaatttaaacaagtcaacacgctcacgttatcaccttctccttcggtagtgtctttctagggtagctgtaatatgaggaaggtttttcacagcagtaattttttctgtcaacggataaagtaacaaatagaaaaaaaattaattatttgacagatgttgactttttggtatttatagatgaacttgtggaaaatgtggaaagcataaacctttttagtgcctctcccttattacaaaataataactataggtatatatatatatatatatattatttttttttaactataggtatatgattccatattaaattggactagaaccaacctcgaacattgacggcaaaaaatttaaatttttttaacactgataatcgattatatcattatataatatctttttatgtttcatatgataattacaacatatgtaattatgatgagaatttcaaagacaaagatttcacaatatagtttaccctgtaacattcgaattgattggcggttctacgtgtactacatatgaccataacaaatgattctgtattcagcactgaaatttccgataatcttgtgttctataactgtaagaaattatttttctgaaatcgaaccccaaacatggtatagaaacctttaaactttgacaaatgaattacaatgctttcacaatttttttttatcatctaccaaaaagaaaaagagaatataagaagtgttggaccatagttacacagattctaaggaaaataaagtatataatctttttaataaagtctatacttatctatcaaaaattgtctttggatacttttagaatcatcaaaaaccatttaaatacccattgaaatgcttaaatattttaaaaagcccaggagaacagatgacgtgtgttatgtagttgttagatattgaaaataataggtatgcacgaaaggaaaatcaggtggtatccatcttggaaaggcgactaaaccctttccgttgacaaaactgaataaaacaaacataccagatcaccaataaccttgaatatatatctttttttttatcaaggactatattataaaaaaaaactcaattattagaccatgagttcgtatatggtgaagtaagggttatattgaaaagttaagcccgccctcttctgattgtcattgacttcaaagtaaacctatatctcttcttttccaatcaagattctctatatataaaagagattcaagaaacatataactacagaaagaaaaaaaacaaagaaacaaatggagacatggagaaaaatgaaatcttttgggcataagagctcttcaagcacggcttcgatcaccaagagcaagtcttggaatggctctgctcatctcgagaatgctaataacaaggaatcaacaggaaagatcaagaaaaaatcgccgccgccgccaccacacggatgtttcacagtttacgtgggtcccacgaaagagagagtcgtggtgaaaacgaaactgttgaaccatcctttgctcaagaacttgttagaagaagcagaggctgaatatggatatagacgtgatgggcctattgttcttccttgcgaggttgacttcttctacaaggttttggctaatatgaagtttaatggtgatgagtacgatgaagaagatgatgatgatgatggtatgattaaccctccgatttgcggtttgggtagtccctatagatgtgctggtctcgagtccatgggcgtgagacgtagcggctcgtacaagcttcttcgatctccatctttgttcaaattaagtaggttttgatttttttgtttggttttttgaaaatgatatataggttttgattttcttttttcccttctccataatactaggtatctaagatcttgttcataccattaccttatgcataaaagaaaaatgcgaggaaaaaaaagaaccctcacatttccctaaattatattccatttgtttttctgagattttgatgtctgattttgtatcttaatttacatgtgagtgtttttggatgacgcaaactttgaattaaagaaattactaaaaacactaacgaaacaaacgcttgtaaaccgaattgtttgttgttgaacttaaagccactacatcaaagatacaagaacatcaaaaataaaaagactcctcactaagattttgattggtagaacctttacaagaacattatattctttatctaatcactatttttattaacttgatatattattcaagtttgaggtggtatgaaaaaccagaaacagaatctttacatatttaaaatagcatctattagatgtaaatgctctttatgtaacgatctcttatgcttttgatgagagcatttaactttaaaatataaaatactaaatataaaataaagattatttaaattaaattaaaaatatacttatataaaaattaaatggtatttaaaataaaatttataattaatatatttaaatcatttaaaataatagtattttagattaagaatatgatgattttatttatgaatcacttacccgtactctgcactcacttataataaaaaaaatttgtcatccactttaataattttattaatgaaattatataatatttgcaacatagtacacttttatagcatagtgctagaattttatcagcaactccatatctatacggatggtaactgggtcattcgaacacatcattatattttgctagttatataattgttctttgaataaatttagtgcatttttaatttagctgacttcaagtttatatttaatcgtatcatatctaattaattttaatatgcaatccttttagccaattaattttatatttagattttctgtaaataaattatgtaatttcattatcctaaagataaaaataattaaatttcgtatgattcatgaattcaatcctgatttactgagaaaacaactatgaagattaatccaatttgggaattcatagattgaattcaccttttgcaatcaaacttttataaagagaaaaaggaattaaatttcggtatggttcatagatttaatttaattttattggaaaaaacaactaagatgctggtccagttaattctctgttaattaggatgttatgaggcaagtattatagaatgaattcaccattgcaatcaaaccttgtgacaattcatcttatgttggaaaagagagcaaagccactaatagatttggggataaagcaaaaagtgcattcaggttatgagattatgttttgagaagatccatggatctcaacaagtcttgttgagttattacacatgttgttcatccaataatgatagtgagtgacttaatggagagccaaaaacatggaagatggaaaaataaggaactttaccgcggaagatgacaatccttgcctataagtcaattgaggcatcaagatagttttgttcgagttatacgaataatagtctatgtatagtcaaattgggatattgagtagctaataatacacttaatcatgaagttgatgtcatgaagttaatacagcttcaaacatttgtttagaaaattaatgatatgtcatcttatgtgacttgacaagcacatgaaaccttatgtaactatgaatttaacaaatcactcatgagatgtgataatcattgtcctcaatgcgggactaaatatgaatccataaacaataatatttttgagtgtccatcaactcttcaaacttgggttttaacaacatcattttcttaatttttggttttctctattttaagtttatataccaatatgaattatttattttatcataagaacaatattgaagactcaaaaatggatagatatccttacccataaataatatgatatatttaaaaagtgcaaaaggctaaagatctgatatcaacagtaaaagacttagtaacgtggtatagctttcctacaaagttaaaggagttatatatcctgaagagtagatttgtgtagaaataaaagttgtagattcattagttagaagacataaacatctcagagatttatatttcgtttgttgttttatttcgatatagtttttcaaacgacttcaagttcaaacttaagtaataaatgagtcatatgatttgatattttttttaaaaaaaattatggtaaatgatctagccatataaaagagaatggtttagtacaattatatgttaactctttattaaaattgactaacgatcggctcggcctctgcctaatgtttgaagtagctctgcggttttgtccgaaccgaaccgaaccaaaatttttggctttcggtttagttacggttttgggttcggtaagcttttgaaaaataatttgatttttggttcggttcggttcgttttcgattttcaaaaaaaactaaaaaaaaaacaaaatcactgaaaaaccaaaccaaaaaacccaaatttaaccgaaaatatccaaaaaaaattagaaaactttaccgaaattaaccggaaacaaaaaaaaatcgttatttcagaaataaaagtgaaaaccaaaaataatcgagaaccaaaccaaacgaaaccgaatcaaaattttgttcagttaatttcgaaattggtttccaaaaattcggttaaccgaaaaccgacgattcggttgggtctctggcagggctaatttgaagtgctggagagaaagaaaagtaaagaaacggcaccgtttcgtatcatttttttttcctcggcaccgtttcgtatctatcattaagcttttttaaccttttaatgcagtctccattctcgggagagatcaattaatactttttccaataaagttcttttgaagaaaaaacagactcgccttcctcgtcatcagcctttcttctttaacctaaaaatggatgatgatgatgctattcgcgtaaagctagagaatctcccgactcctacttccgtcaacggaatcaaaccctccgtaatcgatctctgcagcagcgacgaagaagacaacgacggcatcgatgcttccagaaccgtcggcgagaagagagcgcgaagggactgtgatatcaatactccggcgaagagggtggcggtagaggaagggcttgggcaatcgtcgtcgatagtggctctccaggctacgccttgtaacgtcgtgaggccttcttcgtcggcggcgtcttgcaagcagttctggaaagcaggggattacgaaggaacctctggtggtcactgggaagtctctgcaggtagcgaatctcgaaccgtgggttgtatacttctctatttatttggggtaaagtttgttgagatgttaattggttcaggtgggtttgatcatgtgagagtacatcccaagttcttgcattctaatgctacaagtcacaagtgggctcttggaggtatcttttttatattttttaatcaaagttttcatttttattatttttagcagtgttttatgaagttggttggaataagaatgtttgtttgattttttgcagcatttgctgagcttttggacaatgctctggatgaggtgtggaatgttttgtttctatttttaatattttttctgtttggtggtaatgtttttttttttttttctgttttgggttatcaggtacacagtggagctacttatgttaatgtcaacatgctaaccaataagaaagatggaagcaggatgctcttgatcgaaggtatataatagtttatttagtatttttttctttctgtttgtattcacgttttgatgatgttgtgtttgggaaattttcagataatggaggcggtatgaatcctgagaagatgcgacactgcatgtctttaggatactctgccaagagcaaacttgcaaacactattggacagtgtaaggcaactcttttacctgcaagattatatttttaaatgcttcttccatcaagaatacacttaaagttcatatgctttttttttgaagatggcaatggattcaagactagtactatgagacttggagctgatgttattgtattctcacgttgccctggcaaagatggagataggttagttggttttaatgattttactgggatatgtgttgtgtattgaaagagatcaacaaaagctttacaatgttctgtttgcttgatgttggttttagctttacacagacaattgggctgttgtcatacacgtttctgaagagcacagggaaagaggacattgttgtacccatggtaagctaactgtatgaaataaccattcatataacccttgataatctggaatatttgatagcatgtgactgatttgtaagcataagaaagttaggtaggccagacactgtttcagagtagcttttgtctgaaatactgttagaaaataggcgtcaaactccttgaaacctttgtctgcttcagagttaactgtttgtccaaatttaattagaattagccaattttaatctctcttctaatcttcttctgatggtgatttaaatgaaagctcgactacgaaagggaaggttcagaatggagtccaatagtacggtcttcagctagtgactggaataagaacgtggatacgattgttcaatggtccccattctctactgaagacgagcttctttgccaggtaaaaaacaaaggagttgtttcataatatttatagctacttgtttattttgagaatatttccacttatctgtgctctatggctgttgtagttcaatctaatgaaggagcatgggacaaggataatcatatataacctctgggaagatgaccaaggactgctagaacttgattttgacacggatccacatgtatgtgtttttttttactgtgattttgatctgcaacgatgtaaaagctttctgtattcgtatactttgacacacgtttggttgcaggatatccaacttagaggggtcaatagggatgagaaaagtatcagtatggctgctcagtaccctaactctagacacttcctcacatacaggcattcactcagagtatgaatcttctatccgtctttccttaacagtggcagttgaaattgtttttttttgttttacgaaattcatttgttaccttgtgaattgttgtctccagagttatgtatcgattctatacctgagagttccacctgagttccgtatcattctccgaggaagagatgttgagcatcacaacattgtgaatgacatgatgcacacaaaccaaatcacttatcgtccaaaagaaggacccggtggacaatctaatttctcaaatgtaatgtttttcacaacttagttatactcaaaagacttcttcctgcaaattttatttgaagaacttgcgcagtttctaaatatggttgtgtggcaatatttataacagatgtctgctgttgtgacgattggatttgttaaggatgcaaaacatcacgttgatgtacaaggcttcaatgtctaccacaagaatcgccttattaaggtttctctcgctcttttcggcttatattacctttgtttctgtcagttttttaactgtcccactttgtttttgtcagccattttggaggatatggaatgcagcaggaagtcaaggtcgtgggattataggtaatcgttattttgcaggaaggtctataatacatgattggctcttttaatgtgaagtctaatgcgttagtttgctaaaaggtgttttggaagctgatttcgttgagccggctcatgataagcaaggttttgagcgtacaacagttttgtctagactcgagacacgtcttcttgtaatgcagaagaattattggtttgttgctctcttctcttgctttttagaaaattgccgatgcttcactgaactctttgcgcttctgatttattcaggaggttgaactgtcacagaattggatatgtttcagcacatggcaaaaagtccgctaaagactctgaagacagaggtactaacatcttcttcttttttttttaaacaatcggggttttaaaacgtgtgctaataaacaaatctcttggacatttgtgtagaatcatcaccagagtatgcagtcccaaccaggaaaagagctgctgctgctgcatcgttgagctttaaaactccaactggtgcaaggacagttgtgaatcgaggaggaaaaggaaaaggatctgttagagattctaatggggtcggttcatcagagaaaagtggtaaacatggaaacacctcttccaaatttaatggacgagcaaaggctcgaggagctcctccagctttagaagatatcaacagtgatgaggactctgattacgatcctccgggtgaagaaaatgtcactgagcttcctgagaaggtcctccaatgctctttcttttatttttctccggtaaatagaattatgaacgtaaccttttgtgtacttgttctcgcagagcttcgaaccaccaaccaagccacgttctactgattcacgtaccctcagtcaactagagcaagagaatgaaacgttaaaagagaggttttgttaccttacgttaccatgttatgattcatgtttctcacttgtttgaacaacactgtaagctttgtgttttccttaattctcaggctaaataaaaaggaagctgtttacttgctgttgcaagaagagctgcgacgtgagaaagagcttcgcaaaaaacttgaagctgaggtataaattctactctttaacatttttactgtgtctgcttgcaaacctataagcaacaatcagttagtcaccaatggatgattcctctttggtattgttaggttcaaagaacaaaagacgagttagaagacgtgaagaaagagcaagagagtttaatcgacatattctcagaggatagagacagacgcgacaaggaggaagaagatctcagaaataagctagaggttccttctttcttcttatcacctttctctactaaatcttctctcagattcaggaaatgtaaactttttcttgtggttgcaggaggcgtcaaagaggatccaagcgttgttagatgaaaaatcccgagggagacgctagaggtctggagctagctcggaaggatagtcactgcatggaggaggataccattgactcgtttagttttttttt

SEQ ID NO: 11 - DNA, 59642 bp, Brassica napus
gtagataacaaaataaaactagtggttaatagacaaaataatatatatatatatatatatatatatatatatctatggtttgttattttctgtaaatttttagtttttctaaaacaaatgatataaaaataataaagatttattttaaattttggttttttattttagtgtagttttagtctaaatatattttataactttggtaaaaatgtataattttttgtaatttaaatattatataataaaattaaaagctgatttaaaaaaaaattccagtgtaataaatgtataatacttataactaaagaaattatttaacttttctttaagatttatggtatacatattgactaaaaattataaattaacttacataaaaattaaaattacttaattcatagagaagattattatttgtaagtttttttgtttgttttctagaagggcagatataattatatatatgaaaaattaatttcttgaaagaaaatgaagtcagtcgtttggaaaccacaaaagcacataaaaagtggattttggtttctatgtataaaatagtgtaggagttgaaaaactgggttcccaaaaatacagggaatctgttttagttaaatcttgattgggtaaaaagtagcttttagtgtctccgctggtatcggtctttctcgttttttgggtgtaaaatgttaagaaaaatgtttggaaaaactgcggtgagcgtgtcattctcattttgttatagaacaaaacttaggttcactctctagactggatttttaaattcaccacatctcctatcactaatcaaattgttacctagataaataataaaaatattatttttaaaagaacaaatctaaaataatagaaaaataataatgacgtcaattttaatgacgttaacgccgttatctaaaccctaaaccctaaatcttaaacttcaaaccttaaatttaaatcttaaaatgtaaatctaaaccctaaaccttaaactctaaaaccaaaccctataccctaaaccttggatcctaaactcaaatcgtaaatcctaaacctaaaccctataccataaaggtttgagttaatgttgatgtttttcttttagggtttaaggtttgggtttaaggcctaggatttgggtttatggtctaggatttaagtttagagtttacgatttggatttagggtctaggatttaggtttagggtatatgatttgggtttcaagtctagagtttgggtttagaatttaggttgagggtatatgatttcggtttcaagtctagagtttgggtttagaatttagggtatagtatttgggtttaggggttaggatttagatttaaggtttagaatttagggtttaaaatttaggatgagttttgttagtggtgttaacgttattaaaattggcaatcattattttttattattattttaatttttataaaaaaatattaataatatttttattaatttaggtggtactttgattagtgataagagttgtggtgaattaggatgaaccaaaattttgttctttgttatatactagtggcaaacccccgcggagctttgatttaagttgttctatttatcctgaagtgtataatagtatgacaaatgtgtatcgtattcatggtagcatatgccactctcgagctctgaatgagaatgaaaattttctcgaaaacattgatgaattgatatatgtgagagcttgttagcttgacaatttagcaatataagaatgttattatcagccttcatttcatttttatagtgaaagaaagaatatgaacggtaattagcaataaagaacggttgcgtagtttccaaataagtttttttttgtgattcttgaaaaatacagcgaaacatatctacaatgctagattaactttagctcatggttcaattttctggcaacagttacagcacgagcagaaatccttaacaaacaaaaataagcaaaaccgccaccaccggttctaaccactaaaatgagtatctcattttttaaattagaccgtttgatagaattgcataactgtctaactaagcatttgaaaccacatgggtgttctcggtttcttgatctctttctgagcattttgaaattcaatcttaaaacattgtgactgagagatattacttggacaggagcaaaagggatatttccagagctggttcatatggaaattggcgtatcttactcgagcccaggggcggatctactaagggagtagtgggatctgaccccattaaaatgaacaaatagtttgttttgtataagaaatactaaagaatcttcagctcaattgttgttagttctagttctgacctctataaattagggttcagttccctaattgacactttttcagtatatttttgcagatttcttttcttatttagtgacatctacagtccacgtaacatattattaagaagaatcaaagcccatgtaacatttttaaagcttattacatttttatatagtgaaaacactacttattctttaaaaatacggccactataatacactataaccccggtaaaaacatttctagatccgccactcctcgagccattagctagacaaacgagttatatgtcgctatcaactggtttactactttcgtctttggccgtgacattttccgtatctgattgtgtttgattccaagtgttttcttcttagtttactttacacggcgtggtttatacagaagcacaataacataactcctgagggtatttaaagtttctatttttattgaattataaaatattaggggtgtgtgaggtggtgtatttgttgtattttatgtattttatgtttgttattattttttgttatgaaaatgtttgaaagtacagttttatatattttttgctatagttaattgatgttataggatgatattatcttataccaatattttgaatcccggtccggatccgcggttgaaccgataaatccagtaatccgaatataattcggtttgagttttatgaagaaaccattatttaaaaacccaataaaactcggaactcgacaaccagttgaatactggtcaaaccaataagtaacttttatttattttttaaattctttaattatgttattaaatttttttatttaaattaaaaaatgagattttctgattttacttattttttttctgctgccggatatcgactatgtatctttttctcttttttttttcgtacatctcatttacactatttaatttgtgatttatttgttattttttaagattttgatgaagatccatgccatttgaaaaaaataaagtgaacgatgataaggaaaacctgaattagttgttgtgatttggtcggtattagtttttttggttatcgatattctattattatagtttaatttttaacttttgtttttttatttaaagtttaactttacctttcacatttaaatactatggatttcaagtattaatatttttttattagatgtcataacgtctaacttgttaattgtaaaatagtctgaattaaattttgatgttttgtatgttaaatgaaataaaaataagaaaatttaagtgttttctaaatattcttaaaacataaatatgtattatttttaatacctaataagttattatttaataaatttaattaatatattgaactgcggttcgtccgcggtccatcgagtaatccgatgatccggtaaggttcagtgtccggtttcgggtttcaaaacattgcttatactttatacattatttgtttgtatgaaaatgtgcagtatattttgtattgtatttaattaagattttactgcttatgatagatattgttggagcttaattggtgcttacgtagttatctaatataacgtaagacaagagattgacccgcacgccagtgcggatgctaatttttacggttttataaatttttattcgttattttataattagtgtaagatgtgtcgtcgtataactaattgtattcaaaagatttggactgaatctggtaaaaagattatttatcgtacaattatagtaacccatttcagatacattggttatttagatatttttatgtttctacacatcagaatcaaaatcatttagacccgggatgatccaactcaaacctcatacataaatttataatatccaagtggcgcctaatttcaaaatccaaaaaaattaatcccgaaagaaacaacttgtacctcaatgagtattcgaatgtccatacttaactgattctgcaaataaattaaaaagaaaactctttttatatattaggcaaaaataagaaaaatagaaagaattttttatttaggaaaatagttatatgaagtgaaacattaagtgacaataaatgtaatactttttaattattttgatttaaaattattattttgtttacataaactatgtctcgaaactgagaattttgactcctgatacatgtaatatttgtctatttctttttttttggtcatattggctaacaactttgctgcaacaaaaggcaagcaaaaacacaaagatagaatcaatcattatacataaacaactaacattgcagagacgtcctcgtatatcgacaacactaggcttaagcagtggaatgacgccatggaaaacaaagaacacaatcaatgatctaatgcttgtgattggttccacaactagtgcagaaataacaatcttaacactggctacaatagcagaggcgatgtaacaccaaaatgccgagcttttaaacagtacagagagtaaatcatctgtagagcaatcttccaacccaaaggctgagcttgcaatacatgagcagcaacgatacaaaagccatgataataggaaagttgaagttggttcaaaagaatgttaataatcaagtctgaaaccacaaccaagctaaaaatctacaatttaacattgagtactccattctagaggaagttaaaaagatctgaaaccaagaagtgatagacaacagacactctataacagagtagaatgtagtaattaataagcaaagaacactctttagcagagtagaggaaggactctaaaacatgtttgttaatagacataaaatttatattttgctttagattaatacacatattgatcaggcctgagtatgcatgtgagcaaatgcatattaatttattatcctctgttatagagtagttgtaaatgttaaaaagaaattatgatggtaattatttattaaaaaaagatctagttttttttataattctgattaaataattcatttaggctccaaatgtttccaaccgctccgtcccacaccgcacttaacagtaacaaaaatctctacatatattatatatctatacgtttttataactgatataaccgcacctcagttgtaccgcttgtcccgcaccgcttaatccgctgttaccattcggagccttagttagaccatatagttttgtattttcttgtgaatgtacacatatatagtacatactacataatgtctagaattagatttattggggtttttaggtaataaaccataaaatcttttttagtacgtttaatacagaatcataatgcaaaagaatgatattttaagaaaaggcaatgtcatgtacagttagcgaaaggataagagagggaacaaagtgaactgagaagattaagatataataatggacaagtgacattgtcgtggctatgtctttaaaactcatatatggtctctctttgtttggctttatgtccgattccgatttcttatctacgttcacatgcataactaataatagtcttcataaatatcttctcctttcctcattataattttttttaaatacaaaatcgaatttattgggagaatatttcgtttagatccgatatcttttctaattatttatggaacaaacgttattttatattaactcaaatccactatatgaattatgtatgtaagaacaaatatgaaaggtgaggatgaatataattaaagacttgatgctaagtttggttaaacaaaactaagtgatggtggtttagggggcgactggttttctcgttaccacccgcaaacgcagcttttgcgattggtcgcggttgtcggcgatttgtaacaattactcaaatcgctctaaaccgcttcaaaccgttccgaatctcataaattcaaaagctggctccagctagcatttgcggttgcgaacggttgcgggagggtgaatttttttttctttttttaaaacaatatatatacaaaagtaaaaatgtttaataaaaaatttaaaatttaaaattgacattatgaaaatattaaaatatatctattatattttaattaaaataataaaattttataataaaaacaatttcaataaattttcgaaaattaaaattataactttctaaatataaattttatatttattataattttatgatttttgatatttttataattatattaaatgtaaatattgttaatttattatttgattgttaccgcatttggtagttaaccagtcataagtcacccgcaaacgcaccaatttttaaccgcagtacgagtcgtacaaatctcttaaaaccgctagaaaccgcaaccgcccgcatccacaaactcctgcaaccgcaaccgctacgtttgaaccagtcaggcccttagtgataaaaatgaagatgcagaatgctgagatgatatgtatcagttcgcgaagtactagaggaggtactacaggcgtgtgtcatgaagatggagcttaatgtgagtttgggttttgtgatgtgcgtgggcttgctgagcttggaaaaggaaagatgatatgtgtttaaagacatatggacgttttccataatgcaaaagggagtttgcttgaagatgaagttttccattaatgaaaatggaaagttaccttaagtgtatttggaagacttgaggagcaagttaaggacgtggaaggcaagttctggtctactatataaggagggacgtgccttctgagaaagctagacctgagagaataaagagagagaggtttccttggtgtgtgttactgcttggtgtcgaaggacattctgaagcattgtctgatggagtccgatgtggacttagtttggtggcgttggagttggcgccttgtgtggtggagttagccattgtgtatagctcgtgtgagctttgtgtgtgcttgggtgatcaagcgttttggtgtcactggtgtgcgttgggtgctgacgtacttggtgaagtacttccgagaagtgaaagatcgaagcatagactcagggggagtttagtagaggcggtttcattgaagagatcagtggagattgcagctgtagaagacagtgtgctccgatgcatcggatggtgatctatgcatgcgtgcttgattcctaatctttgtagattgcctacttagaaaagagtggtagacactagtgtgtgtgtgtgtgtgtgttgtatcatatagcaattgtaggttgctccttgttctaagtcaatgaaatctggacgaggtcccgaggatgtaggaaacgaaccccgttaacaaactttgtgtgttttactttctgcacttgtttattgtcgcctcatctgcactaacaattggtatcagagcgggtcacctaagttactggtgagatcatggatgatgaggacgaaacttgttcagaaagtaggacaaagtttgattgaagatcgttgaagatggcgtgatgggatttcttcctaggtttggaaggtgatgatcttcgagttggtttttgaccatgatgtgattcatagggggagatggaagacgtggttttcaagtcggttatgatgagtgcacatgcatagtcaaaaagagggagattgaagatgcagtatgctgagatgatctgtatcagttcgcgaagtactacaggcgtgtgtcatgaagatggagcttaatgtgagtttgggttttgtgatgtgtgtgggcttcctgagcttggaaaatgaaagatgatatgtgcttgaagacatagggacgttttccataaagcaaaagagagtttgcttgaagatgaagttttccattgatgaaaattgaaagttaccttaagtgtatttggaagacttgaaaagcaagttaaagacgtggagagcaagttctggtctgctatataaagagggaaatgtcttctgagaaagctaaacctcagagaataaagagagagaggtttccttggtgtgtgttactgcttggtgtcgaaggacattctgaagcattgtctgatagagtccgatgtggacttagtttggtggcgttggagttggcgctttgtgtcgtggagttagccattgtgtatagctcgtgtgagctttgtgtgtgcttgggtgatcaagcgttttggtgtcactgatgtgcgttgggtgctgacgtacttggtgaagtatttccgagaagtggaagattaaagtctagactcagggggagtttagcagaggcgatttcattgaagagatctgtggagattgcagctgtagaagacagtgtgctccgatgcgtcggatagtgatctatgcatgcgtgcttgattcctaatctttgtagattgctacttacactaatgtgtgtgtgttgtatcatatatcaattgtagattgctccttattctaagtcaataaaatctggacgaggtcccgggaatatagaaaatgaaccccgttaacaaattttgtgtattttactttctgcacttgtttattgtcgcctcatctctactaacaaaatataccttacaacatgatgctactgactcagttttcctccaggtttgatttttataaaactctttcacacctcttatgggcaagttgaaatggggttatatttcaaattcataaaaaaatttattactcatggttactctcaccttgaaaaaaataataattgaattgtgttaaaatccaaatcacagaatatatatatatatatatatgtatatatatgtaagaacttatttttcagcaaaacaaaatttgatttcaagattccacctcatgatattaacagagaaaacattacctcttatttaactggttgatattttatacgagtatggaagttcctaaaagtgatcaaatgtgtgaaataaatatgccggcaaaaggcagaactatgactttagctttcagctctgtttacctttgcttatgtttttccccaaccaactaagaaacatttgtttacttttgtgtgacattactcattaagtgactgagaattttctaactccggcaaacaaaatcatttctaaagaatgctgtattaaactaaagtgattggacccactagtcaagttacttttaccgtgaactactgtttcactctattttggcttcatgcttagtgttctaaaattatgtttgagtgtcctaattaagaacaagagaactaattccacagccggaaattccaaactgaaacctgttttctcaaatctccaaatctatgaagccatatatgtaaatttcgtagtggcgaatcggaatatgtgttgctctatggttgtagttgattttcgacttgatcactttatttaatgacaagaacagcaatgttttgtcctaagaaaaggttgatgagcctgacacaaaaagggaggaagccaagaatttgttggggtcgaacgaagtgtcatgctacagaaaagaaatgtcatggtttaagggtccgctaattcattagatagttcgatgtttttatatagtagagagacagtgcctcacacgtgcatgtacgtcccatctttttcttgtcctgtaagccatccttttaaacactattgttaatccacaaacctaacttttaactatttaaatggttttagttttcatctagttatcaagaagtaacttaaaaacatctccaaaaagtattctataactttaaatatgaagttttttgcattccaaaaaataaatttcaaaactttaaatttgaagtttcatatatttgtttgcattttactccctacaattacacatcacatttaaaaattcttgtttattgttttaatcttttaaaaaaatatctcataaatattttgacttttttataaatttaatttttacatataaaattaaataaaactttaaaataagatttaaaatgttttaaaactagatttaaacaacaacaatatacaaaagaaacttaaaagaaaactttaaaattacatgaagacataactactacacaaatttaaatattacaatagttatgtaaatttgattcggaacctccaaaatctttaaaatattgtccaaacaaattttgtttaaccaaaaatggttgttgttgtttttgatgtttttcgtacgattttttcttgttcagattgaatttatgcacgagtattaacatcatcaatagaagttaagtcttttagcaatattttatttttctcttttacatttttttagatctaatgtatttataatattagtttcactagatttaaataatttttagctcgtattctacaaattacaaataaagatagtcatttttacttcaaaatacactagattatcatatatgcattacaaaaataattttatagaatattatggtattttccttaaatattaatattaattatgttatttctatttaaaattttactaattaatattttgtaatacgtttatatatgtgttagtaaaagtttgatgaatttaaattaataataacaaatatagtactccaaagctctattcatgcataacatggcgggtggcaatccaaaaaatattcacatcacgtatgttttcagtgttgactatacgaggattcactacaaaaaaaatagccatattgttacgaatttttttgtcacaataaagaataattcgtaacaataaaaatattgtgaccagtttgtgacgttctttaaacggtgacaatatgatcgtcacaaattttgttggtaacaaaaaacgtcactctgtttatgacgatatatattgtaactatttcgtcacagatagcaactatttactaaagtaagaaaaacgttagaattaccaaccacaattaacatcacaaaattgtcatattatgtgactgtctacaagtcttaatttcgtctctagttaccactaaaataaagtttcaaaccgtcgcaagaaaatacgaaaaaataattactaatccatcttcatcgtgacttttcgtggccttaaactttgtaacattttattactaaataattgtcactaattcatattacttttttatatttcatcgctaatttatcatcaaacttctggcttaactaattattaatttgtcatctcaaaagtttcaacattgatcactatattattgatgatttgtagtttaaatacatagtaatgaaaacaataccaaaataaactgataacataaataataaaccacaataaaagaatattctaatatgcgatcagattcagtttagcgatctccagttgtgactcatgataaaaggcttcttgatttttagcatcggttgattcttgcacacgaagcgaaaggtacgactgctaacttgtattctttaaagtgaccaccttgtaactggcttcttcttccatgattttattaccaatggctcagatctgcttcacctctgctgtctttaagcttaagatctactctctattgaactctccttaatgtcccagatacgcataccaccacagcgccagaaacgactgttggtgacaacaccgtcaacacaaatctctcacgcttttccatttttacgctctcgctcttcctaaggtgcctctgcggcttttcttttggaggaaatatatacactttttatttagggtttctaggctaatgggctctaagcctctacttattagtctaagggttccggcttaaaatagagatacggtggattcagattaaagtatttttacctatattacgatccatcttcaatagaaatagttgatattttctattgtttatcatttttacatataaatataatcttctatctaatacaaactatatatgtattgttttttctttaaactgatttacataaataataaaattttagtttatacataatttaaaacttatcataaaatgatatataaaacatccatattttcaattagtatgagaaaaagtactttttgaaatccttcacgtttatacataggggcatataaatcgactatataaacattgctaaatcaatttctaaatatttcatggatttcttacatctttgagtagaagtttattacaaaaaaaatttcatctacgatatgtaccagttagaaactattattttgttattataccgtcacaaagtaaaactaacttttccatcacaagttcgtaattagtgtgacgagacatacagtcataatatggtaacagatgttaaccaattgttaatttgtcacaattttgtcattgattgcgacaaaacttagataccatttgaatcatcacaatattgtgtcaaaaaagctactcatctgtgacacaaaaatttggtcaccataacgtatctaaaatgtcataaatttgtgacaaatatttttttgtatcaaaatttagtcacaatataatcattttctcgtagtgattggactgaaatgcataagacactaaacctttcggagatgcgtggattggggcttatttgccaaataaccaaaacagaggtaattagatctgtagtgagaagttagagagatatagaaagagaattgaagagaaagaggatgtttttggttagatagtgtatttgtgtttttgtatctttagaggggcaaatttcctttggttaattccggatatgtatcactatcagtccacttctttaacatgtttttttttaacatgttaattttcagctgtggtggatcatgtactaatcttctcacatacaataaacaaattggtaaactagacatagaggatcattagtattaagatgtcttatagtaaaataaagacaattttataagagttagatattagtagttatgagaagtatataattaatttatgacggttcggattggcacgagttcatcacaaataaataaaaagctatcagtttattatgggattagataacatagtcttgaaggctatgaactcgaacattctttaactatggtccactacaaggcctgagtaaagtattctctacggttcatgcaagactagcttgcgcaacttgattgtggtccaggatccttttttgcttgtagtggacctattggtgactcaaaatgtgtttgtcaggttcatgcagtacaataaatctttttatttttcaagcaagggtcatggactatattattgtgctttgttactatgcatgagccacgtgaatgcatcaatattgatagggccgtttctttttttttcttttttttttcgagcaacaagggctgttcttatatatacaaaataagcattagtgttgaaaatcccactcatgagtgatttaatggtagatggattttgggaaactaaacaatccagattcgaatcaaccccacgatattaaacagtgtagtcacgcagatatgaaactattatttgagtcccatttgaatattcagaaaaaaaattcatatttagaccatgtatctccacttgagagactagtttgagtttttctataggtttgggatactctcaagttaatcaacaaaactccaaatattttagttatataaagtatataatctcaaatcattaaaacaaaattttatatttagcctctaatattaaatgtgaaaatgtatatttgggttaggttgtgaatggttaatggccctttcatttttttcccagctggacgatccatttcttacgggttttgtggtctaaataaaaatgataatgtatgtctgcatgcacgccgatggaacatgtaattcttatccgtgtaatggtggcctctatagcacttatatgataaagaaaaattaaaggtgaattcgaatacttccatgttgcaaatttatgctaatattttcgaatacattttccatccgactgagagaaaaagtgttgtggggttgggttacaaacaaatgcgaggtaggtgcatgttcgatacacgaaaagacatcattatttacgacgtgttctataccccgtccattccctcaacacttgtattgtttaaatcaagttaagaattgtatttttatgatttttactatgattagttggaaatccaaaataattcattaaagatgagaaattagtaacgattagctttcactaatccattttttctttataaccccacacgttgagttatttcggtctaatacgtaagcttcatatgttgtcctttgaaaatttagaaaacctacggatgcatattctctcggccccactctttgtttttttggtaattagcttaatgataaatggtttttaagaaaactaggtgactgatctgcaccctgtgcggacataagaacatgatcggcccgcaccatgtgttctctttcggtctgcacctcacgagagggaacacagtaacgtcagtatgaagaggtagatattgtgtgtatgtataattgcaacgccacaaaatattttgtgtgtttacgaagatattttcattcaaaaaatgaaataaatagtgtatagttttagaaataacatattttatattattattaattagaattgtattgtatatgtgtcgtaactctttattttaggtgaataatattatttttccataaataataaacaaacatttatgtagacatattaaaagaaaatataataaaaatcaaaatattatccataaataatataaattatgaagtatatttctcgataaagaaagcaaattcaattagaaacctgcaaaaattaaataaattttgtaagcaattggacgggttaacattatttgatagatttataaatttttaaattttattgaacatgaaataatattaaattgacataccgtcatcggtctcctaactcatcacaacccatctaacaaatacaaaaaataaataattgtaacagtttatatattttaaaatttgtatttgaaaaaaaagtagattaaatttacgtaccgtaactacgaaatattctgaaaaacttgtttgtagacaacattcaatgtttttgtctgtggcttcccttctttaccagttattaggatttttaatccagatctcgacttaactcttgaaagtgcaactttgccttgcattttgtaagcattttataaattatgataaattatgataaatttattctttaaacaacgataaataatttaaaaataatattaataaacatttttggattttgtaatattgaaaatagttattatataattatattcgaacacaattcatcaagtagagtataaaactattataattatcttatataaaatttcgttcattgtattttatagtttataaatattaaaacaaataaatggtagagtatgtaacacctgttttctaccagcgtgagttagaacaccgccgtatttaagaatcataagggcctctacaggtctttcttcttcgccttcaccatcccactttagcggcttcagttaaaccttcttgtatatccctgagaaatttcctccctgcgccattccaaaaggttctctgctgtgagaaaatgacctcatgaattaaataaaaaatgcataatgctagcttacttataagatagtatattcaacaaaaaaatgatataagatagtattacttgtcccctggtcacatttatgtattatatacatagatcctttgatccttcctgtatattcaacacaaactcttcaccaactcaagcatgaattcttgtcctctggtcacaaaaattataagagttttataaacgcagaataagtatataaacaatgcttctaaaaaatgtattttgtgtgatgtatacttacttctttatcaacaaccaccatttcaatggtgtttcctgattctttgttatagtttatccacaagcgaacaatcctaatttctttttttttgacgctgatttattaagatattacaattacgatatgagaaagattacatagacgattcggcaaccggcaatactacctgccttatgaagacctacgcctaactgcatcacctgagccgtcctatgaaaatccacgcctggccagatttatttgcaccatgttgaagatcccttgtatgtctttcttctgtagtctgcataattctttaataaactgctctctccgggacttgaaacctggatttcttgtaatctgcaataaattgcatagtctgagattcgaaccccagacctgggtgtagaagcctttaaaccttaaccagtaggctagggtgcttccacaacaatcctaacttcaatacgcgacgtatctttacggggttttaattctctcacataagaaacaatatttttttttgctcgcaccattgccattgttcttgtaagagctgaatgtttgtaatttaagcattcgggtttctcatatatatattaagccgatttatttatcatattaatgacccctaataaatattaaaatcgtttaaagaaagatattaattgtgtattgtcataaattgatttgcatatgatatgattttaacttgcgcaagtaatgtaataaatatgataacaaccggcgcaagcaattgattcgaataataaggaaagttattaatatgcaaattagttaacaatcttgcgcaagttatctaattattatccccaaatcgaataaatatatgggcttaacatctaccgacaatatatttgggtttttctaaacaggctattcacatttttctcataaataagaagaccaaacttgaaaatccgaaaaccaacagaccggaaaccgcaaggaatgaaactgactgactaaattagtaatgtgaagctctaaatcatgctgcaattagtgatgcaacagactatcgcaattagtaatgtgaagctcaaaatcgtgctaatgaaacaaaaaccaaacttgaaaatgtcaagagaggactgtctaaatgcttgttgagttattaaggagaagataatcttacagtccttcttcagagactgaagtcgaattgccgattgttgtaaatgtcagttgtctcttcttgttccatcagtagacagtccgcaaaatacatctctggtcgtggcaatggtcttgtttaagagaatcaagaactcaacaacaagaagattaatcagtcaattagatacaaagattcaaagtgttaataagcaaatcgtagtttatagcttaacatatgtcgaatctaatcagtgaaatccaaaaatctttgtatcatagcttaaaagtcgaatccaatcagagaaaccgaaaaatcttcgcattatagcttaaaagtcgaatccaatcagagaaaccaaaaaaactataaattccgagagtatcgacaaacttcacctcgtctggttgtcgcttcaattgttttcatcggtttgaaaccatatctcccttcaattgatacgcgattgaaaaaaaaaaaaaaaaaaaacttcatgacatacgacggtgttttcaaatccgtggaggggagtgaaaaaaataaatgaaaaagaaaaattccaaaaaatcagccaatagaattataaggattttcccgagaagctctatatgagtgccacgtcagcagaaatcactaaagtgacttctcttttaatttttaggaggataattctctagcttgggtaaaatcgtggatatctacgaaatgattcctttctacgtacacgacttttcatcaaatacgaatggttagtacaattaatagtccatccgttcctaaaagatctatgttttagaattttcacactttttaataaaacactaggataagacctgcgccttgcgcagggtgaatttatttatatatattatcgataatttttttatatattggatcattttatttatacttatataatgtttttttgttgttattatataatttttttccgatgaccggatcaatttttattaaaaattatggaactaaactataaataataaatcatgggttgatcggattggacattaagcaaattatgacacaaaaattttattttttccaccgaacacattcttgaaaaaattcaacagtattattttcacagttgaattattttgacatttatcttccatatggttttgaaaggtctcagatcaaccatcgaattgatacatgtcattttaatgtttttaatcgtattcttaagggaaaactaacatttttgtaatttaaagtggttttaaaaaattcaaaatataacatataagaaaaaaatctaatatataagaaaagtataacatataaggtttactcatttttgtaatataaagtcgttttacgaatttaaaatataacatataatgtctcctcatttttgtaatttaaagtcattttagaaaattcaaaatataacatatgagaaaaaaaatctaactttttattatatggttaatgtcactgtttattgttttttaataatataaatttaaacaaaaattcagaaggatgtaaaaattgttatcaaatctttattattcataatcattaattatcatatttatgttaatcacattaggtaatttcgtagtttttatttaaggaaataatacactcttcttatattttagattaatataatgttttctagtaattaaattttgaaccaacattttttcaatattgatttttaagctgtcacgtaagttaaattattatcctaattaaatgacaccgaatcagagtcttttttaattagtacaaacttagagttataatttttaaatgattttcaattaatatacgtacatgagaaactaaaacagcttgttatataactaccgagatatttgatcggattagcataagcaatatttaatagccttggccgcaaattctcaattgatacgccctcacatataagctctatatattatttagtttccattagttccttaggcttaattaatagtcttggctataaagtctcccactacgatgaatttccataggttaatgtgttagtttataaaatatattaataatatattgccttggccacaaagacttaacaaacatattttatggatctcacacgattattaatatttccatgggcagcttttccttgaagaaaaatgagaaataaaaaaaattgattaaattcgtttaacataaataccaaaactggtaatgattgatttaacataaccctaaattagtttgtgatatgaaccggttaaattgtagagcagtactttttgaatcacatgaaactcaaaagtaatctgccgtttttatatacctcacttacagtaataattacatgattttagaacaaaaattctctagaaccaactgaagaaggactccccaaccattgttttacaaaaaaaaggaccccccaaccattcatgcaaacagacatagttatgaccctttaaacaatatcatagtacagattataaagttttttatcaagtgactgaatttttctggtaaaccacgtttgctacatatacaatataattaataaagtggatatgagaaaatcaggaagattaactgaaacttgtgtagcatagttctattacagtggtgaatgttcttattaatcaaggtagataatattaactgacgataatgttctaacgataatgttcctgtcaataatttttgtaagtgatgtaggtctgtttattttcgtacataatgcatagaaaattacatgttctattttctacaaacttgaagtaaaatgagaacatttaatatttattccctataaaatgtattcgtagacgttattacatagttatgcttacatgataagaaaaacatacacaataaataatactgatggattacactatggttttacatagcataggcgcacctgccgtcttatttttagactatgtatatgtgactgtcaaaaattgtatttcgctagggagttaatttataaactatgctatttcttaatgtgttataattctgacacgtcagattttagaaggcttaaacaactgccacataggatggggtctttttttaatttttacaaaattcaggttataactttttaaaagatcctcaattaatatataggggatattaagacttagttataaatacatagttttttttgtaattttatattttatatatttttaaactaataagattctaaaaaataaaattaatgttcttgaactttacaatttctcactattgttgacaaaattacattgaaaatataaaatatgtatatttttaaagcaaaagttttctatagaatatgaatcttttagaaacggaaagagtataagatatgtcaacacgtcaagacgtgtatgataattgataagtacatttactcgtagttaattagggaaaatatgaaactacatatcatatatacataacattattaaaatagaataaaactgtaatcatatggaggtggttcagtggtaaacggacttcagaaaacataaatttgaataaattcgtgtggtcaaacagatatgaaactatatcttaaacttcattctaatatctagaaagacagtccatctataggttttaccttcatgtttatagcaaaaaaaaagagaatgaaaaatgtcaaaaaaacatcataaaaatgtcattataacctaagaaatcgtaatatcattttcatctcgctatcaattcaattcaacctaagtcataactgtatcaactaatgtgtatatatatattgtctccttcaaataaagctcgaaatatgtaacgatttattcgttaattgtttaaagttcatacttaaaacaaagtggcccttcggaaatcacgaggaaatcgaaggatgttctccaccatgtgcgtatgctaaataacaaacacatacttctttttacattttaggatttattcttaaactattattctgatatctaaacacacatatataaatagtagaaatggtacatagcaagtcgcctacattagtttcttattcttgaagagcttcattcgtgaggaaaattaactatagttctctaagtttggcaatctttgatgtgaaaaaaactatggaaaaattccctctaattagcaccagtcccacgtttcacaccttcattaagagaaaattgtaatgtgcactcaattaattccatagtttataggaaaatatgatagtcttttaagccgggctacaactagacgcttgtggatgtgagcaatctaagttagatattacccggcagatactatgacttacaaagtacatcctatgtttctaattacttgtaaacggtgcgctttaggttgccaactctggtcatagagtgtcacaaccatgtgaaaatgttttatccaaataaagaaaagttgttacaagtaattttaatgagtaactagatctcgatccgcgcacatgtgctgatttttattttcatttctttttatataaatattttgttttaaattctaaattagtatatattataatatatatgtgtctatcaatttttaaaacataataagtttacggtatattttttcattgaataatttgtttcaaactttcacatatatttgtatctttttctatatatattttcgaataattattttattattaaactcgtaactatatatataaagattactaaaatattattttattgtcatattcaaagatattgtaacatttcacaaatttagaaagtttttaaaaaattaaactttttcgtttcatagatttatattatcgagtaaataattaaacatttagtttttgttttaatttttaaaataaactatatagtttgaaatttgttttcattggtttaaggtagtaaatattaatcattgttagataatatgatttttgttatttaaatttttttttataattttaaaaattaacatcgacaaatatttaattatttaacatatggaggtatagtattataatattaaattatatctattttatttatactatatataaatccaatggatcatctattgtttaaattcaattattgatagttcaataaaattttctggtaggcctaaaattttaataataagattatagattaaatgtaatatgacttttttagaataaattcattaggtccattttttaaaaaattacacatgaatcgaagttgtgacttatgttttaatatatatataagattgcatatagtccgaacgtacttaatgcaactaagtccaatatatatacaattatattaagtcgttgatgattgaatcgcaaaggcgtgttggaaaacaatcgaagagagaagaagaggtatgttcaaaaaaaagaaaagaagaagaggtagatgaaaccctcaattttaaaattcaatggggtgattaggttagaagtaaaataaaaaaaaattgtgtagaatttagtttgtatgatttttttatttaactgtaaggaaagtattttaaaattttattgctgtagcattattttttctacagctaaaaattgttgttttagaaaatatagtttttttacatctatttttaatcttcctgttgtagttttcagaactattctaaagcataattgataattttaaaggttatagataaaaattaaaactaaaaacagctactataacacaatccaccaccccaagtctccaccactagccacattaaatgaattgattttagttcattcaccatttataatcttattatatattcttaataaaatacaaaatatatatattagaaatgatgctattttttttttgtaactggagaaatgatgctatttttaatcaaccatttaacccacttgacccacacaatgaatttgttctgtttttgtgttgttatttccggataaagtgaattagttccatccaactgattcttctacgtatgataggtttctaagcatctaactagtatgcagtattatattacgtgatgaatgaaaaacaaaaaaccaccaactacgttatgccaaaaatagaacttttttttccgcggggggggggggagaggggtaacaaatacaaaaaaaaaaagttattcttgggttcaccccctagagtgaacttctaggttcaccaaccaatatgattttattatttcaaattcgatatttgttaaaaaaggaaataaaatattgtcaagttatattatgcttttaaaataaaaaggtaaaaaaaaatagttacaaaaaaaagaagtttttaaaaaaaatactgttaacgtcgccagcaaaacactaaactctaaatcctaatccctaaaccctaaatctgaaaccctaaacctttgggtaaaccctaaacccttgggtaaaccctaaatccttggataaatcataaattctaaatcaaaaacactaaacactaaaatcctaaacccttgagtgttttagtgtttagtgtttttgatttagagtttatgatttatccaagggtttagggtttcagatttagggtttaggaattaggatttagggtttacttttttcctgacgacgttaaaaatatttttttgtaattactactatttttattttttattttttatctttttattttaaaaacataatataacttgacaatattttgtttctttttttaaaagatattgaatctgaaataatgaaattctattggttggtgaacctagaaattcaccctagggagtgaacccaagaataagtcaaaataaaatcgctattaaagcaagacatcttccaaaaatataaaaaaaataaaaaaaaccaaagtcatctcaaataaataaaaccgctggatacatgtttagtaagtcaaacaaatcatagtgatgtggcaactgttttttcctcaactttcctcaatttaatttgctagcaatttctactcaattcaattctaagctactacccattaactacttcattttttttttagattttcttatttattgggaagttttattaatcacttttatgatgaactaattccttatatattatttgagaaaattacaatatttaaaacgtgtagtgtatggttctcagattacctaaagaaataaattggtcaatctaaatatacacggtagttctcattaaattaactaaaaaactaattactaatgtaccaaaagaaattattatttagtttcttaaataaaagctacaaaattattaaatgtgatcaatatatatacatgacaactagtgattttgaataataaaaaattgataacaatttgtgtttcttctatattttgttttatatttttaaaataaattaaataatcatattaatcatagaataaaattttaaattttttcttatatgcgatactttgattttttttaaacaactataaattattaaaactgtaaaaaatattacattaaaaattttgtgagtaatggcttaaattttttgttatacaatatataaatatacaaatgatcataaaatcatatgaataaaatatcttatttaatagattttcatattaaaaatatgtttttactatcgtttaaattaaactatataccatataagaacataatagtttaatttgaaatttgcattgaagaaatattgagaacttaatattctaattttatattttgtattaaatttttaaaaacaattataaattactaaaactattaaaagtatcccattgagaattttattttcaatattttaaaaaatacgaattgtcataaaactatataactataaagcattatttaacagatattttaaaatatacttctatatattaatattatttaaatttaattatataccatagatataattgaatttttagattttttatatcaaaattattttaagtaaaaagagtgtttgttttgatttatgtgttcgcgtcaacttaattatatacataatagttatagacttttcagtttattattttattatttcatgtaaaaacgtaaaataaataataatttatatacacaatgtccatcccgcacatataaaaataattcatgttgatcttagcctagtcaataaataatcgacaaaattttagggaacaaaatatatatgctagaggatcgttatgtttgtcttccattccactgcatctacatatggcatttgattctagagtaagaaacacaaataaatttatttggtacaatccttccgtccaaggaaaatctaaaaatataaaagacatcttagtgaagttatagattatggtagcattctatttatacccaagtttaaatatgattgtcgtataacgtattgaatagcaaatatcttcgaatctcatatatatgaaattagtgtaaattttaaacgtaaacaatttatacgaccacagttcgaaaataaaaacaatttatacgaccagaaatggcaaaatgttgttcttagcatttttttttttaactttacttttgcgtaaaacacatttctccaatttggtttcattgcgttgaacgacgtaacaaagtaatacacctaacccttttttttggaacattatacacccaacccattgtacaaaagttacagctaaattaccctttttattcttttgataaataaaaaataaattattaatcattaaaaaataatttggagtattttctcaatgtccatatatacatcttctccctttatataagccaacctcacacacccaaaaaatccatcaaacctttcttcaccacatttcactgaaaggccacacatctagagagagaaacttcgtccaaatctctctctccagcaatggttgttgctatggaccagcgcagcaatgttaacggagattccggtgcccggaaggaagaagggtttgatccaagcgaacaaccaccgtttaagatcggagatatcagggcggcgattcctaagcattgttgggtgaagagtcctttgagatctatgagctacgtcgccagagacattttcgccgtcgcggctctggccatggccgccgtgtattttgatagctggttcctctggccactctactgggttgcccaaggaacccttttctgggccatcttcgttcttggccacgactggtaaattaaattttctgttttaattattttgactctttttgttcaatttattaatttcttgaatgcacgttcgatgagtatcgtcgtcactgacttcaagatttaattcttttgaggttaccttttcatgttcaattattaaaaaataaaataaaatataggatctaagatttttttcttcatcagttcaagcatcatcactcatcagtcgtaagactcgtaacaaaatatcttcttttctataattaatattatttccgcatttaatggatctacgttttgatgttctcaaattttgtttctctttctctagatccccggaacttttaattataattatagtatagtataatatcaagaaaatatactgtttattttttttggcaacaaatatattactcttgtttctttgacaagaaaaaaatatattgtttttttcttctttttgtgttccaatctattttcgagatttagacaagtgacacgtcatataccggatttgttaccttgttaaagagtttgggttaaaacaaatgtagaaaagttaaaataaattgtgcaataaatgataaatacgtttttatgttaaacaatgatgtgaaaataaaattgaataatggcagtggacatgggagtttttcagacattcctctgctgaacagtgtggttggtcacattcttcattcattcatcctcgttccttaccatggttggtaagtcatttattaactatttccatgtaaactattagtacttgttttcgtatttcttacattttcgtttgtcattcttcttgggtgcatgctagcaaactgtaatcagtattaactgggaactaccaactgttttttttttgctagagtagcaattttataattaaataagaatcctattaaacaatgcatgtgacaatatgaggttgcttttctgttcaaaacaaatctttagaagccaatgaaaaagaatccaaaacttttttttaaatgatatgcgcctatctattggtcctgactcctgagttttcttactttcttaagtataattagattttgatttttttttataggttttcactattgttatttgtttacatcagcttcagatatcttcgaaaaagatttacatgcatcaatttcatgaggatttatagtttttcttttacttatttccgacacaatgtttagtagtaaaaagcattaaatgtttttttgctcaaaaaaaaaagaatgggattgttagagcactctattgttagttgttcaataaatataccaactaaaaaaacaaaataaatataaaatgagtgagattgttaaatcattatagagacaatttcattttcacaaaaataaataaatacataactttttataattggggtttgcaggagaataagccatcggacacaccaccagaaccatggccatgttgaaaacgacgagtcttgggttccggtaatctttcctactctcgtagtttctcttgtcttttatttatttgtttgtttttcggaatttattcttatgtctatgttcttaggattctatatgtttattttattagtttatgttttcagtctgaggtcagaccgaccacttgtcagatctgttttctagctgtagtaaaaaacaatttgcaagtgtaatagttcagcataattgatcttgttagagcatttccaaaacaaactttataattttaaatatacagttttttgttctctaaaaaagaatttaaaaattttaaagtttgagggacgaaacttcaaatttgaactttcactactcaacttcaaatttgaaatttcatcttttttatttacattttgatcattataattaattatacattacatttatgattcttaagtattttctcatttattgttttaattcttaaattttttatacatcataaatatttccaatttgtttttataaattcaaattttacacaaaaaagtaataaaaattttaaataagatttataatattttaaaactataattaggcaaaaaaaatattacaaaaaaatgtaataaaaactttaaaataagatatatcaagacataattattagaaattttaaatattataacaatattaataatctggtaaatttgctccaaaacctcaaaaatttctaaattattgtccaaacaaatttgtttaaccgaatatggagcattacaaaaataattttatggaatagtgtggtattttgcttgtagttaatatttaattatgtatttctatttataattttatatatttaatgtaagatttttttaattaatattactgtaatatttttatatatgtactagttatttataaaagttttatagatttgtattagttataacaaaaataaggatcattgtgtaaaatacaaataattttgaaattacgtttaaagttttggttatgaaaaaaatactttgaaactttaaatttagagttttgcaaactttaaaatgttagatagatagtttttttggagatgcatttagtggttatggtagtaactcagaaaatgaaaaatctatacttttatactccctccgttttttaatataagtcgttttacagttatacacgtagattaagaaaaccattaatttcttatattttctagacaaaaacatcattaattatttacctaaccacaattcaaccaatataaaaatagaagatatattaccattggtcatacaacattaattattaataaattttacatagaaaaccgaaaacgacatataatttggaacaaaaaaatttctctaaaacgacttatattaaaaaacggagggagtagtacctaactttaacgatggaccacttatattcgagtccttagcataaaatgattctcctcgaaatccgtttactttcttcattattttttccttttcagttttggcgttttcgtaatacttttgtcttcaatcttgaaagctattagtataaaaacttataaacacatcacatgcaatgaattaatacgaatacataaccagaatgacaaattttcaatgaatatttaataccagtaagtactactccgtaatagtaatagtaatagtcatattaatttttttttgtcatcaaacaaacagtaatagtaatattaattataattatgtatttcagttgccagaaaagttgtacaagaacttgccccatagtactcggatgctcagatacactgttcctctgcccatgctcgcttacccgatctatctggtaaaaaaaaatacaatttcaatttttttcttaaaattacaaatggttttatattttgagttttaagccaatatataaattaattttgattggattttaactacagtggtacagaagtcctggaaaagaagggtcacattttaacccatacagtagtttatttgctccaagcgagaggaagcttattgcaacttcaacaacttgctggtccataatgttggccactcttgtttatctatcgttcctcgttggtccagtcacagttctcaaagtctatggtgttccttacattgtaagtttcacatattattacaagagatttatatattattaataataaatttgttttttgacataaagttttggaaaattttcagatctttgtaatgtggttggacgctgtcacgtacttgcatcatcatggtcacgatgagaagttgccttggtacagaggcaaggtaaataaatcaatttttaaaaagaaatgtacagaaagcaataatggttagtattgattaatcttaatttttgatgttttgcatacaataataggaatggagttatttacgtggaggattaacaactattgatagagattacggaatcttcaacaacatccatcacgacattggaactcacgtgatccatcatcttttcccacaaatccctcactatcacttggtcgatgcggtgagtgatctagctttctctctctctagtttcatttgattaaatggtgattaattactaatttaattaatgaattgtggacagacgagagcagctaaacatgtgttaggaagatactacagagagccgaagacgtcaggagcaataccgattcacttggtggagagtttggtcgcaagtattaaaaaagatcattacgtcagtgacactggtgatattgtcttctacgagacagatccagatctctacgtttatgcttcggacaaatctaaaatcaattaacttttcttcctagctctattaggaataaacactccttctcttttacttatttgtttctgctttaagtttaaaatgtactcgtgaaaccttttttattaatgtatttacgttacaaaaagtggaagttttgttatctttttctctagttgcaatcaaaaggatctttaaaacttttttgatttggacagaaagaaaaagacagttccactgaaagtcgacaaaatgcacgccgtttttgggtcccagcacaacaacaatatgtcacggagttgtcgcttttttaagtaatgggcaatacttttcggcccaaatatataaaagccttcttaaattgcgtcaggtatctcacgcaggacctaaataattatacaaacatctcattcgtccccatatattaaagagttgattacctagtaggccactttttgagttttctttgcacccaaagctactttccgcttgtagcataaacattcacggaaactgaaagagtttttggattattttgcccttactgaaacgaaacggaaaattggaatattgtttgtgttgtttttgttcggttagcttttagacatttattagattaggtttctcgatagttagatttttataaggaccacaagatcgtaaaaaaaatgttaatccaacaatcacgttaaaatgaccagtttagcaagttacagtcatccatatttcatggatgtggatgctatcatgtccacaaatacatgttcggtggttatggatgctttcgtgtccatgtaaggatgttatggttactcagatttgtggatggagaaagttggataaacattacttggatagataaacattatgtggacggacgaacattatggatacaaaaatagtggacatgtaagttgtgggcagacaaatgttacaagaatgagttatagacgagaacacaacatgtaagggaacaaaagttatttaacttaactttgtggacaagattttatattctacaattaggcggtaaattaacaaattttgtcggaactgtttatcggaaagtgatctgatgattccgaagcacttctgagaaatattggcgatgatcatataaaaatcaatattttaaaataaaaaataaattttggataagaagtataaaacatattgtagacaagtttctgcaagaaaatgtgtgaaaatggcctgcgaaaactaaaatcaatataaaaaaaagacttattcttaggtccactccctagggtgaacctctaccaataggattgttttattttatattcaatatcttttaaaaaaagaaacaaaatattatcaaattatattatgtttttaaaattaaaaggtaaaaaaatagtaataattacaaaaaaaatattttacgtcgtgagcataacattaaaccctaaaacctaaattctaatccctaaacccttaatcctaaaccctaaaccattggataaaccctaaactctaggataaatcctaaactctaaatcaaaatcactatacactaaaacattcaagcgtttaggatttagggttttagtatttttttatttagagtttaggatttatccaagggtttagagtttacccaagggtttagggtttacccaagggtttagggtttacccaaaggtttagggtttatccaagggtttagggtttagggattaggatttaggatttagagttttgttgagaacattaaaaatatattattttttttaattcttttttctgtaactattatctttttttacttttttattttaaaaacataatataatttgagaatattttgtttctatttttaaaagatatcaaatttgaaataataaaatcctattggttggtgaatcaccctaggggtgaacccaagaatgactcaaaaaaaaactataaagtttcttctgaatgagcttgcatgtttttttctctacgatcagtgatgttaaagttcttccttgtaaagagataatctctccagcaatttgctttggctccttcttgacgccttatccttcgctgacaacaaaggtcttcctcactatctgaaaaaaaaatctaaacattggttgagagagtttgatggtgaagttagagaaagaggccaaagttaaaacctttgatttaatggggcgttggataagagaccacagatctggaactgaaaaatgaacaaaacccaatgatgttagtagctagccaacgagtaaccaccacaagttgctggctcttcaccattatcagcaatgaactagggttttgttcccaccattggtgaatctgaatcgcagcattgaggggctccacaaccatggcggtgacatggaagaatttgttacgtttcgtcacacagtctcgtctccaccctttgattactacatctcttgaaatcatccattggacaagacaacgacagagaaaacagcttcgttgccacaactgtcatcaaggttgtgtggacaaataaaaatggagataacaacctttgagctcatctactctctgaaactccagccaacaaatcccgaactcaaccacatccgatctcgagctcacccacggcgagttccaagctcatccattctctgaagtaaagcgaatttgggattaagagagaagaagagaataaaagaagcgttgattaggttttatcaatttgggaatttggtaattagagttccaaaagagattgtcggtatcttccactcctctaaggcaggccgcaaacgagaaattaggagacttttcgagagagatgggtttcgtggctgagagaaaagatgaaataagggattagggtttgaaagttgattttgaaaaagtgaagtgaacagatagaaaaaagatgggctccattaattttgaaaacctaaagtgaaaatagagaagaaagacaggccccgtgtaactctagtttggttgctggaagttggttctttctttagttagagggcactaagaccatgtttatccctaaaacacttagtgggttttctaatttttattttattttattttgtctgatttaaaaaaaaaaattaaaaagtatactaatcgcgggccgtcacgtgttggtggggtccgcgcacagtgctaaaaacccacaacaatctctattattaaaagagaagtacccataaaaaataaccctaaaagttacacaatatttacagtcaaatgccattgagaattaaattaatcttacactaaaaatgattgtcttttccacatattaattgtttttctaaaataactcaaacaaactacaaaagaaagaaacatattattaataactcaaacaattacatattattaaataaaggaataagcataaataattctcctgcaatatcaacactgtaacattccttattatatgagtcccatcctttttttttgtcatcatatgagtcccatccttagcttacgtaacctgtacgaacatcaaattatataagctttataagaaattaaactaagaaaaactaacaatgattttcatatgagtttgaacaatttcaattcactttatttcacggtggtgtatgtagcttatttttaaccaccttattatattgaaatattccactgacttctatatgtccaaataattaataatcattattattaattaaaatctaataattaggaaaataactgtagttttgagaacactggcgacggcgaatgcgaatttttagggttttgagatgtttcatggatgggatccggggtctagtggatttttctggaattgcaaggagctctatcttaatgagcaaatcgggagattatggaagcaaaatggtcttcttgtcataaggagaaagggagatctgggaattttatttggctttgatcttgtactgtcaaagatcggaatcgcggagattcgattgagaagggagaaaagtaaggcattcgttaacatcaaagcgagatcttttctactaatattggggatttctttttgctttttggtgcttagatatctggtaactggttataggaaattcgggatttggggtttgatgcgatttgatattcaggaaagtcggaatctaaggattaatggggttagagggagtatcaatagagaggatctcctgattgattttctttacgatttgtgttattatataaaggagggtgttcagagcttcagtagcacaaacttacaaatctccttctttctcttacggatttcgtttctggttgttttttctttggtatctatgagtcagggacaattggtgggaaaggggggagcctcgaaggagggagaaggagttcgcaaaagattgaagatctccgttcctcatttcgataactcggaccttatcaagagctatgcaatgactctgattgggaggtgtatgaacccggttgcgcaaaaagtcaactcgttgctggtgatgttgccgaagatatggaaggtggaagagagggtgactggtgcagatttgggaaaggggatgttccagtttcattttgagaaggaagaagacattgaagcggttttggagtcacagccgtaccattttgattattggatgatctcgatagctcggtggcaaccaaggatgacaaggagctttccttcggagatccctttttggatcaaagtggaaggtcttccaacagagttttggtcaactccagcgcttcaaagcataggcgatgccattggagagactacggatgtggatctggactatggaaagatgcgagtggtgcttgatggcttcaaagagttaacactggaaacatccgtggagttcaaaggaggtgaattctatgatgaggaagaggtcccggtatctcttaaatacgataaattgtttggcatttgcaagctctgttctagtctatgccatgacgaggatcattgtcctcttaatcctaaaagtgtggacaagaaaacagatagcagagaggagctggctaataagaaagaggacagggcaaggagctacaaaggagtggtgattcatggagaggagagtcaacaggagaggggcacagatcaacggaattattatggtaaggggaaagggaaaatgcatgaggaccaggactcaaagtgggtacgagttcctgaaagaggaaacaagaggtactcgtcttaccacgataacaacagaaacgatgagggaaataacagacacaagaacactcgttgggaacagcctaggagttacgtgcaggaatcgcgggagaaggggcatcgtggcacaagacgggagaggagtcctccgcattatgcacgagaggagccaaaggaggaaggggagctgcaagacacaggcagtgctaacaaaggatctcaaatggaaggaaagacttctgcatctaacaacctgcagattgaatcgaatggggccagggcaaatttgattaagcttcctcctaaatccgtggaaatggagaatggtgcaatagctgcgatagtttcaggaacggttggggcggggaaaggaacggagccaccattgggtgacaatggaaaggatatggaagagaatgaagtaatggacctagctgagaatgtgattccatctgcaggggacaaaggttgcatgggtgaggatgaagctttcgaaaatcttactgatggagagatggaggaactgaatggatcacaagaagtggtgctggagaccgttgaggaagaatcacgaccaacggatgtcgaggagaaggaactacaagttggagaggaggaaaaaaagaagggcgctcgcaagatactaaagcacacaatggcggcaggagcttcaaagaagaagttcgttcaggcactcctttcacagaacaaaaatactcaagctagacagggaaagcgtcagggagacggaagcaaattgcaggaggataagggttcttcataccccaaacaaacttcctcaaagaactcaactgcatcccatggttaatacaattcatatagaattgaggagtggacttctggttgcgtcggtttctgcttactgttggtttatttcaataagctctaggagctttcttctacggttcaatttgatttttgcattgctggttttatgtttcagtggcaattgcctatcttttattgtatttggttatggttttggtattaagaataataattgtctttctggtttctatgatcttgatatggttaaatattggtatggtgttaagaccctttattcaggtcagatggcgttagtggcttggctgtgtgtagggatgcatttggctcacttcatacaatggatgttggacctgatctctgtaaaacaagttcagtggaagaatgatacaaggagggttttggacaaggtacttgggtctggtttcattatttggtataaggtggcacttaattactcatttctggatagtactaagtgcacggtagtttggagatgtttgttgcttggtctttctaaggaacctagatgctctcgagtggctatgtatttgaacacattatattgttatggttatgggtttaatttcagggatagagatctgagatggtccttaattatgggtggagggggaagaggtagagtcatggacacgtcttggatcattgcaggggagcacactcttggcttggtctcattaaaccaagtgcagagaacctttggatccatgatcggtatcaagctggctttctcagtgccgctgcaagatggaagtggatacgacaaatatacggtgtctaactcttggcgtttatttaggacatgttcaaaatatgcaaggttattgtcctttggagtcataatatgggatataatatggtgggtgaagttttggtttcctttggttactggtttatatgtacaggtcgaaatgataatgtgttttggtatcctgagtgtacaatatggaactgatgagtattggataattgatctagttcgtaaaaaaattatatcttctcctacaatcttatatatcgttacatacattgttaattgggccttatggtttattattagaagtggtgaatgtgatcgtatagttactggtgggctggagagttggataaattataagatcacatggccttttttggtctttcgtttttgtcaccaaaatttgagtttcttaatcaagtggataattttatgggtcttgggatgcgaattgtgtttattggttacagttggtatgggaatggttataggatcatgggtatgtgatggtgatcaagagtctttatatataattgtccttacaagcgattgtgaagtatctgaagttttttcagataggatgattaggcttattgaggttaaatcttttgtcggtatcatcaaacctatcttttctggttcgaacgataaatatatatatatatatgaagatattaagctggaattgtagaggtcttggaagtcactggacaataagttatcttcgggagatatggcaccaacacaaaccggagtttttatttttgtctgaaacgaaacaggatttcgatttcgtacaaagatttcagtctcattttggctatgatagcctggttactgtggatccaaatgggcggagtggtggtttagctcttttttataataatgagtatcaagttagagtcatatattctagcaatagaatgatagacgtggaggcggtggttaaaggaaaacaagtttttcttacttttgtatacggggatccggtaccaaagctaagagaacaggtatgggagagattaactcgatatggattagcaagatccgaaccttggtttattattggtgatttaaacgagattactgggaatcatgaaaaggatgggggatccctaagatgtgcaacatcttttattccgtttaacaatatgatacggaacagtgggttactggaattcccggctcgtggaaataaattttcatggcaaggaaggcgtggcaaaggaaaggatgctgtgacggtcagatgtcgattggatcgagccttggcaaatgaagaatggcatacgttgttcccgtgctcctacacagaatatttgaggttagtgggatctgaccaccgtcctgtaatcgcttttttggaggacaagttattgaggaaaaggagaggacaattcagatttgataagagatggataggtcaggaggggcttatggaatcaatagtgacaggatggacggagaatcagggtgggcaaattgaggattttgttacaaaaattagtaattgtcggcatgagatttcttcatggcgaaaggataatcagccatatgggaaggataaaattagggagcttcaacatgcactcgaggaagttcagacagataatagcagatcccaggaagagattctggaagtttccaggaagctacaagaggcttataaggatgaagaggaatattggcatcagaaaagccggaatatgtggtattcatctggagatcttaataccaagttttaccatgctctaacaaagcagcgaagggtccgcaataaaatagtgggtctccacgatgaaaggggtaattggattactgaggacaatggaatcgagaaggtggccgttgattattttgaagacctgtttagtacgaccactccaacagaatttgatggttttttggatgagatcgttccgtctatttctccccaaatgaatcaagttttgttgagaatagcaacagaggaagaggtccgacaagctttatttatgatgcatccggagaaagcgccaggtccggatggaatgacagccctctttttccagcattcctggcatgttattaagaaggatgtggtagaaatggtgaacaattttttggttacaggtgctatggattcaaggctaaatactactaatatttgtatgattcctaagacagagagacctacaagaatgacggaactgaggccgataagtctttgtaatgtgggttacaagattatctcgaaagttttgtgtcaacgcctgaaaatttgtctccctctcttaatatcagagacacagtcagcttttgtggaaggcaggttaatatcggataatattctcatagcgcaggaaatgtttcatggattgagaaccaataagtcatgtcaaaataagtttatggcgattaaaacggacatgagcaaggcttatgataggatagaatggagttttattgaggctcttctatataaaatggggtttgatgcacattggattaagctaatggtggaatgtatatcctcggttcaatatagagtacttcttaatggtcagccgcgaggccttataattccccagcgagggttacgtcagggggatcctttgtctccttatctatttattatgtgtactgaggctttaattaggaacatcaagaaggcggagagagacaaacggttaaccggtatgaaggtagcaagagcttgtccagcagtctctcacttactattcgctgatgatagccttttcttttgtaaggcaaataaggaagagtgtcaaactattctcaggattttaaaggaatacgaagcggtttcagggcaacaaattaattttcagaaatcctcaattcaatttggccacaagattatagaatccagtcggcaagaaatgagagatattttgggtattcaaaacttaggaggaatgggatcttatttagggttgcccgaaagtttgggaggatctaaggtacaagtgtttggttttgttcaagaacgcttgaataatagggttaatggatggacttttcgattttttactaaaggaggaaaagaggtgattattaaatcagtggtcacggctttaccaaatcatgtgatgtctgtttatcggctaccaaaagcaacagtaaagaagttaacaagtgcagtagctcagttttggtggagcccaggaggaagcacaaaaggcatgcattggaaatcatgggataaagtgtgtgtccctaaagacaatggtggcctaggattcaaggatctcatggattttaacacagcgatgcttggtaagcaaatgtggaggctaatagacaagccacattctctcttctctagagtttttaaaggacggtattacaggaatgcttcacctcttgaaccgatccgttcttactcaccgtcatatggctggcggagtatcatatctgctagatctctggtttgtaaaggactaattaaaagggtgggaacaggttcatctatttcggtatggaatgatccttggatcccagccactcgcccgagaccagcaaacaaaaaccttcaaaatagttacccggaccttacagtggattctctcattaatatggaatttcgaacttggaaccttcaggcaattagggctgtggtggatcctcatgatgtaaaaatcattgagagtatgccattaagcagaaatctgatggaagatagaaatggatggcattttactaacaatggaaaatattcggtaaaatcaggatatcaggtggaacgggtttatcctgatagagaaaaaccaccagaggtttatgggcctacagtggatgtccttaaagccttctgttggaaaatacggtgtccgcccaagatacaacattttctatggcaacttctttcaggttgtatagcggtgttgaaaaatctaaaggcgagaggaatccatggggatatatgttgtgctcgatgtggggatccggaagaatcaataaaccatgtatttttcgaatgtcccccagtacgtcaagtatgggctttatctaaaatcccttcgagcctcagtttattccctacaggatctttttttggtaatatggatcatcttttttggcgagttaatccaaaaatggatgatcatcaatttgcttggattttatggtatatatggaaaggtaggaataataaagttttcagtaacctggatgtcgatccaagggaaacccttagactagcagaattggaatctacactttgggctgcggcacaggtgaacaacgaccaaaaacgggaattacaggtacataccagacccatattggtaacttcaggacgctggtgttttatagatggatcatggaaagataaggatctattttcaggacagggctggtatagtatcctaccgggtttcgatggcttattaggggcacggaatgtaagggcatgtctttcaccactacattcagaggtggaggcgctgatctgggcaatggaatgtatgaggaatttaagacagcttcatgttacgtttgcaacggattgttctcaactggtgaagatggtttcggaaccagaagaatggccagcatttgaaagttacctgaaagatatcaaagtcctacaaggaagcttcaacaactcagagattgttcatgtacctcggacggagaataaaagggcggatagcttagcacgtagtgttaggaaacaatcgtctttcgtcgttcacatggatgcagagttaccgatttggtttacagagtcaagttgagtctgtgaatgtcttgttgtcaaaaaaaaaaataattaaaatctaatatttttgaattgaaaatcttttccctcccccaacaatcttctacttagatttcggaaaaaaaaatagaaacatttgcggaatctactaatttgtttctaaacaagatttccccttcaatttcggaacaaagaagatatatataaaatttgatccataactactaaacaataaacacaatattcgaatttcaccaatataatcttactctctcctattttgttagtttcacaataacacacaataaacaaagtattctaaatattaatgcaaacaagagatgccttgcgagggtggttaagatatttcctcaactttagggttttgtattgcgttaaaaaaattgacccacacacttgcggaacaagcacaagatcttatcatttcctatttcaaatcataaccattaagattttaccataatttcaaaaacaataaacagaatcaacaaaatattcttttcatttatttcgcctaatatgtcttgcaaaataagcaaagatatttattctcaactagggtattgtccctctactatatattctacccgagtacaaacccattctacacattcttttaccacttacgctgatgaaacattacaaatggttttagctgatgaaactgttagttctataatatttgtattttttttttgaattttataaagtagactttgaacaaaatcatctcttcctatttttgaatgtttttttgtaacttagtttcattattatttttggtttgtctaaataatgtatttgttttcaaaaatttcaataaaatatttgaactttatattcaactttaaaataaaatatttataatttaatttaataaaaccccaaatatacttaaacctccgatactttactatttaatttaccaaataaactaaataaaaatacaataaaagaaaaacacaatctcatagtttaaaaatgatggctaatcatattgaacaagacacaccgaaatcaaacctgaaaaacatatgaatctataacataataagtacaaacaattaaatttatcaaattttcaaaagttaaaaatatatgattatgaaaaacaaaatcatccttttttgaacaagaagaaagcccccacgttctgtcttggatggtattaccaatatttcacattctttatctaatggaaacgaagaaacaacaacaaacatacatcgtgatatcaatcaagaggataatgattttgttagaggatgatgattttattcatagcctttgaaaaaattaatttccgtaaaagttataccttatttatctatttcatatatcatactaactcataattttttatttcatcatattttaatggttttcaatagaaatgtggtccaaattatattaccttatcacagtatgatcaattttgttgccaccgtgtgatcaaattatgttacagcaatatttgtattatgtgatgtatttttgtcattatttgtattaaaattttgatatattatataatggtgtaaaaaaatttaattacattaagtaaacagaaaaaaaacacccgcccggtcgggcgggaccagatctagttggttattatttcatcaactttgttaccggtttttgcataaaacatgggacccaacactgtaagaaaccctataattacctccgataaacatgccctaagagcatctgcaatagtgagtctcaccatgaaattcttagcattattataatatactagagattttttccgcgcttcgcgcggattgtatcttataaatttattttatttataatattatttgttggtttttttatattaactttttgtttttccgatgttagttttttttaatttaaatttatatgtttatatttttatatttttcttgttgtagatggagaattatattttttattgatggttttttgtatgtgacataaactttttgaaattttaaaataatgttatatatagtacgattaacacattaaagaagagaaacatattcagacacattttacacaggttttatatgcataattttaaacattatatatgtatatattataagtttgaaacatgtaaatgctttctaaagctaaatacttgttctgagtttacataacttatcgagagttttatctctttttaaatttaaatcacagaaaaaaaaatatcaaaaagtcagtataaatggattttttgggcttttaaatcaacactgaaaaattacatgaattagataacaacacttttataaacaactcgataaaatttgaccgagctaaagattttcacacaatatgttctttcttcttcaaattgcgaagagcctataggcacaaggaaaaaaattataatttttgctttcacttatataacattttttctcctttacacacgaagtttattacactgctataagcaatggaaaactctattcatataagattcacatctatgcattttgacaaagaagaatttaagccatctttagtttcggaatggacaaacttcagtcatatacactatattttctctatgattcaaatcttacaattttaatatatgtgcagatttccatgtaaaaaagcacgcacgccatctatcattcaacctattactttttccaaagtaaacactataatcctcgtttgattagctccacaaactaatctctttggatcagtttactaaaaaatatggatactaatgttagaaaagaatataaacactatcaacaataaatattggcacaagactatttggttcaaggaacatattcaacgtaatgcgtttatatcatggctggttttgcggagaagactgccaaccaaggatcgcttgaggcgttgggggttaaatgtctccggaacgtgcgtcctttgtaatctggaaatagagactcaccatcatctcttctttgagtgctctttctctcgcttgatatgggagccttttgctactgaaatttggatttttcctccggctgatctacactctgttgcagcctggatcaatcaacctcgcgtcaacgcagatgcgcatgctacttcagtcatcaatctctactttcagtccgccatctacctgctgtggaaagagcgtaatgctcgtatgttcacagctgtctcctcaccttcatcagtcatccttgcctctttcgaccgtatgatgcgtgaccgtctcttctcttacccggcaaattcttctttctcctattctctacttctttttatctttcttgtataagacctccttaaggctttttctaccttgagttgttgttggttgtttttgtttccttgctgtaacaagttgtttaaaaacaacagtgtaacttttcagaaaatgataatcttaacatcttaccaaaaacaacaacaaatattgacttatttatgtgaatatatattttattttaaatcattatagtggacgaagaaaacaccataatttgtacaacaaattttcttagattcacctcatcatactcaccattttactattttatttacataattttacatgagcttcttcaccctccccggttattttatctttatttataactacgatataaagttataaactatattatagattaataatttatttatccttgaagtctaacgattaaaaatagaacataatttaatatagatatatgattctattaataaattagtagttacaaatttgaaatttctagaaatatcaaaagtcgtatgttagttaattatcttcttagtgacatttatttttaattttttttggatgaaaatattttggctgaggtagatactctcaaaaaccttgaatttagtcccttttatatagtaggatatatttttttaaatagttaaagatcctaatccaaaaggtacgtacaatggtgttatctaatttagagtcttcaggtctgaagctataaaacatatttcagaaaatggttttgttctaaagaacttggcgatctattaaatttttaatcagagtttgatctaaaaaacttgtattatattctatcttgtattatattctatcttcttctgtttccatatagtcttagagtcagaataggatgtacaagttacaaacatatatgcttattaactaacaaattaattttatgtgttttggtagtaaccactcatcttcttgaagaaccaatgaaggagaatgatagtaagcagaaaaaccatgaagatgcagcaagattgtccacttccacgtcttcttccttcacccgttgtagtgtcctttatttcactacactcctcctccgtcaaccttactggaacattcagtgctgaagaaccgcagatttcacatacactacaaaaaagagaaacagaggttttacacaatccatatggttactaagctaatgaactgaatagagtacctgtttcctcttagcttaaaccaagcttcagcgcaatgaaaatgagcaaggccaagctcatttttgcatttgcaaccaatctaaatcaagtctacacttacaaacttgccagaaactctatctggcgtttgatcagaaccaaaatgacaaatcctgcagattctttgtccattatcactttcttctcctccaccactcagatcaatcatgtgaaactccttctcctttgctttttctgaagcatcactctcgtgacaccatctttccccattcttgaatcattctctttttgatcttccatcaatacatggtttgagagagagagtcactggtctcacccttgaggccagagactacaatcacagcctcagggacagatccactcgaactttcacaaacagtgatcgaatttgaacaaggtatctggtccatttcattcatatacacaccaaaaacaaaaccaggagtggttgtatcaagatcaagaatgattgtatcagacaaagagttaaacataaacccaaaactgaaaacctgtaacagctagaacatactcaaattattggtacgcagagtcctaaagtacaataaagatcgaaactttaccagaatcaagatctagtagagtgacaaggtttcgtttttatttcagaagaatgataaatcagacaattgaatctaaaccctttgccggaaacggatgcgcgccgctacaagtgctctctaatctgttgctcttcggtttcagtttgtgttttttctttcataagatgcctcagctagattttaggccagactcgagaatcaatttttttctctgcatcggtcgagactcgagtatgacgacttttttttccccactaggaaacacaaaaaccttcccatccattcacaagtagccacgtaccataaggatcaagtcctaaaattccttagttatatatgttccagtccttagttttattaagcaaaatattattattatatgtgtatttacctaagattaagccctaaggattggtgatgttactccgttgcgggtggtctaagaatatgattattgagagtttttatggtggatttttagcggaatataagaactccactctaaaaatttctgctctaagagcatgattatccctaaatacacattagattagttaatgactatttaagtattaaattttagtgaaggaatttagttaagataggattggagaaagaaaaaacacattaaaagagaggaaggattcaagaatgaagagaagtgttaatggaaggttcttcatcaatatacacttcagttcttatcagtatacatatagtttgtactatataaatcatacaaaagagaagtattctcaaccatttggtgatgtagtttttattaccatacaaaaacaattctaatacaagcgtgtctcaagaacacaaaaatcgtttcagtttttattatctttcgaggagcttgtactgagtgtcgttcaagtaaaacgactgagccgtctccatgatccatttcgcctcctcgtcagtgagtttgcttgtgaacaaaacatcacctcggataaacaccaaggtgtgttacaagctgtcaaacatacttagatcattaagcatgatatacacaaaacaaaacaaaaaacattgaaaagagaacaagaaaaacaaaaaacaaaaaacattgaaaaaattgagaatgaagaatatgacgacaatgatacaaaagtttgtatactgataatacactagcatacaaaacgtgagtgacgacaatgacatttcttcactaggccgatgatacaaaacgttactgctcccacagaagcatacaaaacgtctaacgacaaactatcatgaaacagggagcaaggcatcgactcaaattggccatcacctctttcaaatcgtctgtttgtttagtaaggagaaaataaagagtctagacccaaattggctatgtacctcctataaaacgttatttattttgcaaaacaggaaacatggaacggtggttatgcaaatgcaaaacacttatatactgtataacagtaaaatttcaaaggaatgacattgtgaaccattcactatagaaaattcaaattcataatctcgtaatgctgtcaacatccatgtaaagctcagtgcgccatctaaacaaaatttcttcataatccacatttcattagaaatataaaaagggtcaagactcaacttcgaactattaaaaaggaaaaattcatttcgtgtagaaacgttgtaataaacaattttggaatggacttagtgatatcatattagttgcgtttttaataaaatccttaattacttgttaattaattgaaagagagtaacagaatgggtcttcatatacaaattaagcacaccgaaaaatgcagaatcctaatatgaaactgatactcatatgataactaataacgttacacaaaatatacagaaaaccgtaaaatgatagaaagaacaatagcaactatggtaaaaaccaactaaaaccaaaacatgtggcaatttggccctccattaaaagctatataccacagtttagctcagctataagcttataataatatacactagggccgggcccgcccttcgggcgggaagtttgaataaaacaatttcatatgatttatatttatttatgaataatttataattatgatatagatgatatcatatacaaacaacacaaatgagaacttttaagttataatatactggttatgagttcaattttagtatcatatattactatgagagtaatcttcgctattatttcaaaagtttagttttagctatcctccattagactaacttataaattgatttaggtgagtacgacccaaacccccaaagcatccttttattattcgaggccttttgtttttttttcatgatgcatatatacacatgtgaattttgtacggaagaataatgtataaattggagaaatcttattatttgttattaagcttgatgcaaaagtttaatttaaataatgtttcaataaatttggcgggtttgtttacggtttctttgtgcgtatgtagtcaataaattaaaataataacaatcttcgcatgcgctgtccatatcatgctggtgacattctgcttcgggctccatcctggctgtatttgctaaataccttgtcttcaaaataactttgatcgatttaagtgaagttttaataataagtatattagcttgtggacgacagacgtacactcatgcacgtaaccaaagttttgtaatacataatatgattatggacgtcagtttatgcacacaatttaaagaacattaaatattttcacactcatatacataattatattagaccgtggactgtatacatacactcatactaacgtacccaaagtttttgtagtccataatatgattatggacgtccacttacgtacacaattaaaataaacactaactcttttaataaaataatcactaacatttattaactcatcggaatcaaataaagcatcaacttgttccttttttaaacttatgtcaactcaatataaaaagcattcataacaaccataaagtagagagtttgaaaaaaaaacaactggaatgtagaaaatccataacatagatagaaaaaagatgacaataaagtagaatgcagaaacattattaagctgcagaatatcgagagatgattatcgaagatccatcttaagcaatacgcgccctcttacgcacattaccgactggctcctttccagctctctttgatgtctcacaattgcccttgccggaaccagactccacacggttgttaggcccgtctggcgcatcatcatcatcattgtcatcaccttcctgttacattcaaattgttatacgctgcatatgctaatggcgaaatatcataataagtattgcacttacatcatcgacaaattctggagctggtgcacgctcaacctcattgatgatacgcgacacggtgaacgtctggtggttgacggtgaagttgtagggcgtgacacggacttggaaagtgtaggtcttgcgttccattcctgcaacgaacggaggcatcacggaatcctcagggttcactccttcttcagccttgtcattaaatggaagcatcgagagtatcaacaacattatataataaccacataagtaatcaaactatatattaccagtaactggaccgcctcacttgcccggagattatgcaacttcgtcataacaccatcaaagcaaacaaatgtcccttcagcagtatcatcagttacaaccatctcaacgcgataactaaaagagaacaaataaaccgaaatggaatcagtgtgacgcaagggataaagaaggcgaccaactatcatattataacaaatcgatacataccgtaaagatccgaccgcatgagggttattacagcgtgcacattcgaaagaagtgacagtgcgttgcaatttcttgctgcacttagaacacgcaacatagcaccaccctttgtccgattcaacccgagaaactctcgcagtgcataagaaatctatttcctgctgcttaaacatcaacattgcgtgcagtcaaaaaacaatctttatatataaacacacgaatgagctaattgcatatacataactcattacctgtggcgaatccgtagtgataaaatggttaagctctgcaattgtcacagtctcaaccttcgcataagacttcaagagaggtgcggcagacggaagaccagtgtctctagccaccaatctgaacaaaagttcacgaaattaacatcacaaactctcaacgtctgattacatactcagaacagaccaaacttaccggtaaaataaagactctcctgcatgtgtctccttatcataataaacatgtgttcctgacgttgcgttgaggaataaacgacctacacaaaatagtaaaaatttctgaaaaaggaattacacatattaatttatgccacatctttaaataagcaacgaagtacctccaaccatcttcgggtttatgcttgtggcaacaatcactttaggatcatcacgcatgcctccaagcttctggtggaataaaacggcttgagcgtcaaacagactaagagtgacagacacatcactgcacatatataacaaacgttagtgcagctaaaatgattaagcaaatatgaaagttgttaaagaaacaaataaattacttttctaatttgacggtgaccatgacacggttcttatcctccggagggtcagacacggtgctcttcaccgccacgatttcaccaataatatctacaggttcaatattgagatcagagagctcagtgacttaatacataaagcacaaaacccatacagataaatatacatatgtacgatacgatcacatctgtacctggaagctgagtgtttgtattggctaaaccaaccaactcggtctggttacggaaccggaatccctctgccggtattggcgagaccggatcagataacacgtcaaactcggtggaatcgttaaaccggatcatcaaagaagagtccacaagcttgaagttctgagcacagcgagccacgtcaaagccagaaacagagtacatcgtcccggcggcgagcctatctcggaaccttggaagccgattcgcgttgatagtagcttggatcaaagtcgactgaaacagataaaatttagaagtcagaaaataacgtaaacagatctaaggagaccaggaagaatcaaacttacattcacgtccataagtagcatatcgacccacatcagctcgccaccgcgtttgacgttcctcgcctcccagaaccgtagaagccgggcctcgacgacggaggagcatttgccggacttcaggtcagagaagaagactctcgaaatagacatagcaacaggaatcagaaagtctcaagagaaagaaagagatgatgcgctggagatctatagatacttacatatttatacagatctgctcgggttcaaatggcgcatcgaagagtctgagggagggattgaatgagcgagggattgaatgcaattggaataaagacgacgacataactccggccgtttcatcgaagaggaaggaatcgaagacgtcacgcgtcgccggcgcagaaaagggttacgcgagagtaatgtgtcttagggttggagacgtcgtgacatcgttcgggctgtgagtgtaaaggcccatcacagaaagatcgagcgaggcccagaagataacatgttcagtttaatgaaacgcagcacctcgtcgtcagtgacacgtgtcgacgcgagaggaagtgaacgtggatggcctaagaagagattaaactgtcttttatatatatacatttagttgacaaagctcaaactcaaaccaagccgatgacaaaaactctcaggagatctacatataactatcatcacacactatatatatatatatgataaaataaaaaccgaaatgattagatcacttcaactctcgccggtaactgtattcccgccgtttcctcttcagcggtagaatcttgagaggcgacaagtttcacagcgaaagaaaaattggaattatacttttgtctcgcttcagcgaagcttgaagaaagaacggtttgcatccactgatcaaccgttttctcttcatctggtgaccatctcaaggcagctagaatctgaaggatcgcatcgctttcgatctctagacgtgtttcatgtccaaacgaccgacgaaaatgcgacaagatgctcctttgtatgttcttcgctaacccatcaaagtcgatcgttttgaacgtcactttcccgtcaacttgctcgaaaaaatcctcaagccaagctttactgttctcggacattgcatgcgcttcttcatctgcgtttgcttctgtctcatccactggaagattcagatcgagaaacgaacgttgagactttacagctcgaagctctgtaccctctgttcctaactcctgtcttcgcttattcagaccgttcttgttagcattgtcggcgagttttatctggagtttacattttttaggggtgagaactcttccctcggagtattcgacacgctcatcaagaatattcgaagtagtagctaaaactataacattcttcataccgatctctcttccgtgcgagtcacggagcttaccagttctcacagcatcagacagtcttacctgatcaggaaactcagctttgtccacgttctcgatgaaaacaacagactccacacgcttggacacttctccggcgatgtagtcaacaactgttttccctctgaatctatcgtcgagccggtcctgtgccttgaaatccacgcaaacgcagttttctcgcccgccgaagaaggcttcagcgagagttgttgctactttcttcttcccgacttgatctggtccaagaagagcgagccagacattacttgtggctgaagctagctggcttctatcatctctgtatccgcagatgatctcgctaacggcgttcacagcttcgttctgaaaccctactttccgagagagtaattctctgagagacttgaagtctttgcagtaccgtgacaatggtttctctttgctcagctcaaagcctctccggttaagtgataccggtgtgcttgactcctggtagattgttcctagccctagatctgttgtaacacagctcaaaggcgagttcgttgttgtgcgagttgtgtgatcttctatatgttttggcttcgagattcttacagataaaccgggttggtgtggcggattctcagcttgaagggttgaaacaagctgaagtgggaactgtggtctaacaggctggaagctgagtttaggaaacgccggagtttgatggattcgttgacaaatgtcgtcccatttcttctgcacagaagctagtgtgtttggatcatctttagcctgcactgaatgagaactaaacactctcaagatagtaactgagagattcgaattcagagaagaagttggttcataaaagcagcacctgtctgagaatccctttgtcttgttcagattccacattacgtaaccaacaaggcaacttctctgaacactgatcaccggacttacctaaggctgtgacttcttgctcacacttctcgttacagagatgacaccgaggaagacgagactggttcattgagttactaaacggtactctgaaatctgatgttgatgagaagaagcctccaaatggaacaaatgatcccatcaaactgtagatgaaaccacaaaacgtcacgtttcaatcaaaaatattttagactttcccaacactaaataccagtgttataaaagttgggctcagaaagcgcctatgcggcaaatcatgtataaagctatttctctaaagcgatttttttttaaattcagtccgttcgttaaaaaattggtctacacgcccgtctaaacattagtttcttgtaaaatgcataattatagcttaactattttaaacattgctaaaaacaaaaacattcatcccgaaaattcggttaaaaaatcggtgtagacacccatctaaacatcagtttcttgtaaaatgcattattatagcttaactacatattttaaacactgctaaaagcaaaaacatttatccggaaaattcaaatcatccgataaataaaaaaatcttaattatccaaactttttactgaattgactataattatatagaaatatatgaatctaaccaaacgaaattaaatcggagaatttttcaaacacagtattagagatttctagtttcgaaaaaaaacaaaataaaacgaaaataaagccactataaaagacattaccttgacttgggataaactccttgattcgaagatgtaataggaagaagatgaatattccagtctttgtcaatcgtggggaacctctcgatcagtttcaaatacatctcgttgctcgacacactcccgacgaaccagagcttctcacaatgaagcttcaacagctccgagagcctcgacacgagagcatcactggttaagaccttgagctctcctagattcaaaaccgtccccgttttagatttcgagcagctttgctccacgattctccccaactcatcgagtttcatctcaccgatctctttcgctacactaacgacgcttaacccactaatctccagaggcagaaaccctacctttcctctgttgatcgagtcactaaacgttttgagcgctttaccgccgcaagttccgacaagaagaggattcttcttgtctttccgacccaacacttccccgattctccgacagttctcgtcgaagtcaccgctatacccgaatctcgcccgaccagagccagattcggttacgttacatagaaacagtggaggacagcgagaacgcgggaaccgcgtcaccggaggatgaagcacgtcgagctttatgtccgtgctccgaaacccggcttcgccgaacacccggctcacgatcgggtcatcgagtatcgacaatatgaagtacttaagctcaaccttcaaaaccgacgtcgtttgagtaaccccaccgtggagctgatggagatggtaagtctccgggtgccttctctgagtcgcctgagagcgtttgatcgccgccatgagggagttagacaccggcggctcttcctccgcctcgttctccgtcgtcgtcgtcgtcgtcggagaaggtttcgaggaagggagtctgtcgagagatacgccgacgcagagctcgagcgcgcggaactggaggcgggaagagtacggcgtgctgtgagcggcgcgtgaaatgcaaacttcgcggagaatcgaagaaggcatggttaagagaccggagatggcgtggagagacgtcgtttgcgcgtggcttctcctacgcgcgacggctaccgcgtcgtctagtgcgcgtgctgtttcttccgttaaacattgcctcgccgtggtaaccggtgtcggcatcgtcgcccgctttgatcaatttcaaactacaccaaccaacaaacaaagatcgtaaaagaataaggagaatgctgagaaatgtataaacaaatcgcgcgtgaaatttctcgaaatggattttacgacaaagatatcaaactgagtagtcgctttttttgaaaaagaagtatttttatttatttttatgttttgtttacttctgttgctttggtttcagacctcaggcttacgcttagatatgtaagaaagaagagtcgctgtttaactggtctattgtgaataggtcccactaatatgtaatatttatgtttttttcttttcaatttataatcatatttttgtatttttgttgttgcccccaatcctcgtgtatattgaaggagcaaaggcacatgtatagtgagcatagattctctatggcccaagtgaaagatctccttttacttctattggcttatactctttcaaatttcaattaattttagatttgacaatcccaacagtttttcacaattattctctttcataattttctctctaatttttttaatatcctcttcttttattcttatctttaagaatctgttcattcagctgataaaaatatctaaatataagtatccatgcatatcttcttcttcttttcgttatttttccaactttgtatccgtattatacacattacacttccacaccaactcaatataagttttggtccttcggtttaagtatcttgaatctagatgcaagttttattccttttttgcaagctttcttttagttttgttataccactattcttaaatatttgagaaaataattaaaatgacttaattcatgctaaccaactaaaatcaggtaataaactaagaaaaatatataaagcatcaacactcatctaaaaatgaatcgacaaagcattaaccataagatcatattgagttatacagggaagcacaaaagccattataatatttcagaatcattacaattctcacgtcaaataaagggatcagtcaagatcaatagatgttgtactaatcgattagttttttttttaaagagaaaacaaaacatgatgatcatggttaaaaaatgtttgcttcaaaaaagttctgaacttgattgatttgaatagaaaattgatactttatgtaaaggattttgaattattatgcattttaaaaagataataagaatgattaattagacaggtcaacttaaattataattaagaatatattcagtggtagacagtgatataattttacttttaagagattagatggatgtgatatggtaaagaataaaaacaggagtaagtgattaggccccaaccccctttataaattccaccaccaccatttatatgctacttttgtgtcgttgtcattgcaaaagtcttttattaataataatgaagaagaaaataaaacttcctttgtgttctactttttatattctccattgcaaaggcctccttttgtctttccccttttggaaaaggagatttactcaacgagcaataattattaccagtgaaatagtttttgatattatcacaccagttaaggacaaacaaacatcgatcaccggaacatcggcttaataaaattttttagatttatttttgtttcaaaataataaattttttaaaattaaagtacttttattagttaatgcttaaaaactgtatatttttaagaaacatattaattgaaaatatttgaattggttaaatactatcagttgatatttattagaaaatatataataacataaataataaatttaattgtaaatatttattatatttttaatatgcgtgaatactctagaaaatctgtttttcagaaacagagggagtagtaagtactacaagttagtaaattcagttttaaaactaaattgacggcctatactatagccagatataatttccagacgcatgatccaaaatttccagaatcgcgaacgaacaacatctgattgttgcatccagttactgtgcgcggatgccgcgtctggaattctcatccagtttacgaaacgaacagggccatattgtgagtcaacctcttcatagctccatattgcttcttgcaagagttgaacttgttcctaaactttatccatggatgcctcaccccatatgtatcataaaacttgtctgcaattgtctttctcgcagtctcatggagaaccttatttttcacattgcctttcagttcttcttcaattcttagttgaagcacaaaccgtgtttgttcatcactccacaatacagtctatgaacaacacaagaggaccatctaagtcaagactaaactaaattcaatgcattaagaccatatctaagtcaagactaaactaaattcagtgcgtaaagaccatctaagtcaagactaaatgcaacacagaaacaccaaaatagagtgttgagaatgacttacatcacttccagggacagatgccattcaaacttgaacagatagtcactgaaacaaaaataaaaacgagttaatacaagactttaagactcttaagcgcaaacaatgaaacaagaagaccatactctacaaagacacagcaacaaaaacaagaagaccatactaataaaacaagagcttccttgtattaagagctacggttaaatgaaggtgggaaagtaatcattttcttccctcagaacacaatgaaacaagaagaccatactaaaagattgttaccttactaaaagatctgttctgtcttattttgttttcttgtctgaatgtaataatgaatatacaaacgacacaacacattcattagctctaagcaaccttactaaagattgttaccttactaaagagagtctgagcttgagagggtttgaacttgagagagcctgagcatggagagggtttgaacttgagagagcctgcgacctgcaagaaaaaaaataacagaccttttgaagctggcaaatgacagtacatgttttgtgacttaaaaccacttggtaagagagctcaaatgctcaaatatacaagaaaggacgtattggtgatgtaattcagctaattaatcacaaactcactgatgagaataaaacaaatgcatcacaaatatacacataacgtcataccgtgagagagtgagcttgagagggtctcgagagagtgacttgagaggagcaacagctttacacaaacctaagcatcaaaaacccaatgctatcatcacttcatcaacccaaaaacccataagactcaaatcaatgtggtatcagagatagttacctcggagaagagagagctcgagagagatagctcgagagagagaactcgggagagagagcgagagagagagagagagagagagagagagagag

SEQ ID NO: 12 - DNA, 28086 bp, Brassica napus
  misc_feature (27461)..(27461): n is a, c, g, or t
  misc_feature (27463)..(27463): n is a, c, g, or t
  misc_feature (27465)..(27465): n is a, c, g, or t
  misc_feature (27467)..(27467): n is a, c, g, or t
  misc_feature (27470)..(27470): n is a, c, g, or t
tttttttttttgcttaaattttaaaaaaaaaattaaaaactaaccaactgcgaaccgccacgtgtcagtatggtccgcgaacagtacaagaactacaccaaattcgcctcttgagaaaagaagaaaatagtgggttttagttttttgtgggcccacacttcttaagaaccccttaaaaatcagggataaagatagctctaagtggtagcctcatttgagaatagaatatgctttattggtgtttccactttgttaatttctcttgttctcttgcatcaaataaaactaggaatacaaatttgaaaatactgttttgaaagaaccaaaatctctattaaaatccaacataggacgaatgaaaattttctaaaattatgtaggaacagttttacgagctacactaatagcaatatctttattattaactggtcaaatgatatacatactaaaagtttgatttgtaaatcaacacgccttgggctagtggtatttgagagataatttcaatacagtgaacccgcagttcgatctctgttggccataaaataatttaacattgtacttttgagatctacagaataatcggttgatcatattgtggttaattcaaaaaaaagttcaatttgtatttaaaaaaaaaacttaaaaggaaaatcaaaatcttttaagatatatcgcagacatgcgcatcagaaaggcttttatctatttgggccgtaaagtattgtccattacttaaaaagtgacaactccgtgacattattgttgtgctgggacccaaaaacggcgtgcattttgtcgactctcagtcgaactttttcttttgtccgtcccaccatcaaaaagtttttaagacctttttgattgtaagtttgtaactaaaaacatagagaaaacgaacaaaaacttttacgatttgtaatgtaaatacatttaataaaaaaaagtttcacgagtacatttttaacttaaaaacaaccagaaataagtaaaaccaaaggagtgttttattcctaaatagagctaggaagaaagattaattgattttggatttgtcagaagcataaacgtagagatctggatctgtctcgtagaagacaatatcaccagtgtcactgacgtaatgatctttcttaatacttgccaccaaactttccactaagtggatcggtattgctcctgacgtctttggttctctgtagtatcttcccaacacatgtttagctgctttcgtctgtcgcatgtcattaattaagatcactaatttagtaattaatcaccctttaatataatcaaatgaaactagagagagagcgagatcactcacggcatcgaccaagtgatagtgagggatttgtgggaaaagatgatggatcacgtgagttccaatatcgtgatgaatgttgttgaagatcccgtaatctctatcaacagttgttaatcctccacgtaaataactccattcctattattgtacaaaaacatcaaaaattcagattattcaactactaatcattattgcttcttataaataatgttgatctacttaccttgcctctgtaccaaggcagcttatcatcgtgaccatgatgatgcaagtacgtgacagcgtccaaccacattacaaagatctgaaatttttccaaaacttttatgtcaaaaacaaattatattagcaatgatataataaagaaatatatgaaacttacaatgtaaggaacaccatagacttttagaactgtgactggaccaacgaggaatgatagataaacaagagtggccaacacgatcgaccagcaagtagttgaagttgcaataagctttctctcgcttggggcaaataaactactgtatgggttataatgtgacccttctttaccaggacttctgtaccactgtagtcatccccaaacaaatttaatttatatttagttaatactcaaaatctaaaaattcaaaattgtaattataatcaggaagaaaaattaggaattaggatttaccagatagagagggtaagcgagcatggggagagggacagtgtatctgagcatccgtgtactgtgggacaaattcttgtataatttttctggcaactggaatgcaaaattaagattaaaatgtaaattaatatttaacagtatggttatatattcgaatttattcattgcatgtggtgtgtttataagtttttctttttattagttctacgtaaactccaaaattgaaaaatactaagaaaagtaaacgaatttcgagaagaatcattttatgccaatggctcgaatataagtggtccgttgttaaagttaactacagtactataaacaatttaaatcagttgtttactacagctaaacgacaaatctgacaagtggtcgtcctagcctcaaactggaaaaaggattgattaaaataaatacatagaatcctaagaaaattaaaatgaaagaatttcaaaaaaaagaaaaaaaatatgagagagggaaagattaccggaacccaagactcgtcgttttcaacatggccatggttctggtggtgtgtccgatggcttattctcctgcaaccaccctcagttataaaataaactattattttattttcataaaaatgaaattggaattgtcaataacatatcattttcgaagcagatggtaagagcatgtttaacggggtttttaagatgggattcttatcagaatataaaactcaaccccaacatgaggccatgattaaaactgttttttggtttcttaatttttttctccgattaaaaaaataaattaaattaaaaaagaaaccaatcgcggaccaccaccagtgggatccacaaacagtacaagtaaaagaccaaaatcgatccttctttcgcgacttttgtaaccggttttttgttttttttgggcccacactatatcttattattaatattttgttaaggacccttcttagagcactaagagcatgattattgagaagttctcagggtggagttcttagcggaatataagaactcgtctcttgatttttaactaaaaaaactaaaaaacggttcttaaatacgagttttaaaagccggttcttaatttttttagttaaaagttaagagatagattcttatattccggtaagaacctcactctaggaacttctcaataatcatgctctaagaaaccccatagaacatgctcactcgtttaactaagttattcatttttgagcaacaaacaagtgtatctaggaaaatgatgcatgttcgtagacatttcaagctgatgtatccatttaacaataaaataagccattaaaacaaaaatatataaatattattaaactcacatatgaagctacattaatttattcaaggacatgtcatatgataatagctaattggaccataaataggcccatagcattaaataaaagtttggttcttttttcttcgatgctaaagattttgatgcttttagtcacatgcattattttactatggaaaattaatatattttcagttatcagattacagtttgctaacatgcaccaagaatgacaaggaaaatgtaagaaatacgaaaacaagaataaatttgcatgaaaaagatgtttaaataaatgacttaccaaccatggtatggaacgagaatgaaggaatgaagaatatgaccaaccgcagtattcagaagaggaatgtctgagaagctcccatgtccactgtattattcaaattgaattttacatcataaacatgtttatcatttattgcacaatgttaattaaactttactcaattcaaacgttccaacaaggtaacaaaaatagaatatgacgtgtcacatgactatatttcgaaagtagattggaacaacacacaataattaaaagaatcaatatacagtaattatattgttactttcaaacaataaaatgtgttttattgaaactttcaaacgtagatccataaaatgcggaaccaacaataattataggaaagaaaaagatgtttagttaggacttatgagtgttacgatttgatcaaaaaaaaaagttagcagtgttacgactgaaaaagagaagaattaaaaatcttagatccccttttgcttttaaaataggccaatttgggtgaacataataatttttttttttaaaagtaaacctgaagagaatcaaatcttgaagtcagtgaaaatctcatatcgaacgtgcgttcaagaaatcaaagacgatgcaaaaaacgaaaaaacatataaacatatcaaaattaagaagttgaagaaaaaataaattgaaaattaaattaccagtcgtggccgagtacgaagatggcccagaaaagggttccttgggcggcccaataaagaggccagaagaaccagctatcaaaatacacggcggcgacggccagagccacgacggagaaaatgtctctcgcgacgtagctcatggatctcaaaggactcttgacccaacaatgcttaggaatcgcagcccttatatctccgatcttaaacggtggttgtgcgctcggatcaaacctttcgtccttggaatctccgttcacattgctacgctggtccatagcgacaaccatcgccggagaaagagagagctttgagggatgtttctctctctctaaaactgtgtgggctctgagtgaaatgtggtggagagagtttgatggactttggggtatgtgtggtttgtttatataaagggagaagatgtgtagagacaccaaactgttttctttttttcttaatttaggaaacttttttattctttgaagaataaaaattgtatttttgcggtaacctgtgcgcaatgtatctttgttacgtcgttcatttcgatgaaaactaagttagagaaatgtgttacaaaaaaaacaatgctataaaatttacagaagattttaaaattgcattatcgagtataagtaaccatggtaatggtatcaaaatttaccaagattttcttcttttgtttctctttagtttttccttagaagtaaggattgtgcaccgaaatggtagtcaacttgtatggtttttcattttcactgattgatatttacaatttcgcaaaaaaaatacatgtagtcgaaaatattatgttagtcttcgtactctattttgtttctgctaaaatttcctgactatgtataaatcataaaaaacgatccatatggatatcatgtagattgtagacatgccaacatttatatagattttttttaaaacgtattaatttgagggaaaatagttgccacatcactgtgatgtatttgacttaagaaacagacttccatcagtttttatttattttagacgacttaaattggcggtttatacaatgtaattgttattttccccagtttgtcattaattagttaatgggaaaatcagttggattgattgaaccgattcacttgatcccgaaataacaacaccaaaatagaaccaatgtgtggggtagggtttgaaagaatttcttaaaaaaatggtacaattttttttggactaaaaacatggtataattccaactatattttatcggtttaacttttgacatataattaactttgaatggtgaataaagtcataaactaagatcaaaacatttatggtgttttgataataaaagacatttatgggttagtcaatgagacatcatattttagaaatgcaggcaagatggcgtttcctggccagcctcgagatttcgggggcttatgcgatattggtaaagatttcattaaaaaaatttaaaaaaatttggaggtctttttaaaaaatttgggggcctatatttatgtagtttttttcaaaaaaattaggggtcctaaacgaatgtttcatccggctttgcccaggaacagctctgctctacctcttcttctctcttaaattaattttccaacacgtctttacgagataagcatcaactaattgctacaattgtatacagaatttacttagctgctgcctccattaactacatttcaggttatatggtagtgtatgtgcattgattataaatacgcagcttcattgcatatattcaaactttttgttggaatgatttccccatctttaagaatcgggtaatggacgtgaaccgtgggtttactgtttaatttattaactatacttatatcagttttttaatatttaattttatatgagaaatcgattaatattactaaaacacaaaaaattgttttcttgcgttattttatggtttttgtcactgaatttgaacatgatattttctctttcattaaaggcaaattaccctgttatggtttgagccagagaccaaatactatatattacgtctatatatacttaatcaaaataagagaagattatatgcactctacctttaaacgtgagatctccaaaactgtcataaaaacgtgatctcatttcttcttccaataacatatatcaatattgtacatccaattccttcctccataaaaacgtgaacacctttcttcttccaatcgtaatatcaatgttgttcatccagttccttcctccacaagctttttatcggaagaatctgcaagcgtgttaaacaaaccaccatggaagatgtaccccagcttctgtgagagttttggagaaaggagatctacatgcaatttcttctagcaatcttttttaacgtaaaacatttaattttctcatatgtgattctatgatgcttgataattaaaatatgatggccttaatgaataatcttgatgatgtttttagtaagtcaacagtttagcatatgagattaactttttaaatattcatttataaaatttactgcagtttgtataataactaattacataacaccatattcttggatctaaaagcatctccaatataaaattctattttttcttctaaaatagaataattcgattgtatagttagtttactccaatcctactcatttttggagtgaaagcaatgatgaacaaaaaaataaaaaaaaatctatttattctattataagtggaaaatataatgtggttgaagcatttatttactctaaactcctttttgaaataaattatgaggtgggattggaactattctaattgctcaaattcttatgactatatatctaggtaagccatggaaaaggaaaggtacaaatgatgagtgtgggcgtatacatgaagcctgcacgtgagagttgtagctactcgacaaacgtatactaatttgttgcgtaccatctccacttcatatatatatttatatatctatgtgtgttgagctgagatatgagaataaaatttgagaatatacctcaaaaatgcaaagagaagtatgtgtttgttatttagcagatgcacatggtggaggacatccttcgatttcctcgtgaattccgaagagctaagttattttcttttaattatacagctttaaccgagctaattaattaatcgttacataatttgagcactgtttgaagaaggcagcgtatatatacacattagtatagtaatacagttatataggatccagttttctttgtttgaaaacactcatatgaataatatatacttttaaaacacgacctgtaacattttttgacccggtttatatgtatgtgattcatatatttctctaaccacgatcgagtacgactaaatgtgcttatcaattatcatacacgtctctacgtgttcatctatcttttattatttttatcaaccattcgtattcgtgtacgttgaaaggaatcattacgtagatgcccacgatgttaccgaagttggagaattatgttatttagaaaacccatttttaattacgctaattaccaaaactaatatggggtcgtaagaatatgctttcggtaggcttcgcgttctaaatttacaaactatagcagtcaacatataagaggttaaatgtattagactgaattttttttaatgtgtggtgtggggttacaaagaaataaaaacgggattagtgaagcttattggttactaatttcgaaataatcatgcatggtaaaaaatcatgttatacattgttgtatcagaccaaaaaaatgctatctcggattttgaatattttacagtcaaaataagtagatttaaaagaatcttgtattactgaagttggaatttagagattattttgaaaattagatagttgaaaattgattagatcgttgtagtgatgagttgacaaaaaataaggtggtctaaatatatggaaatttcgtcctgaagataacaaaggcctttgatcttgcatctagtgcattattaatagaagaatattcacaagaatcttgtgctgtgtgaccatttttgtagaacaatggccacaggaaatgttatgtttcttgtatctagaacaatagtatcgggaggactaattgtcaccaaaactgaaaaaataacaagttaactaagtgtatcgatacatattcacagtcgaaataattaatagaggacaacttgtccatcagttgttaatcttggtggaaaaggttgcttgttaattgtgttaaatgcgagtagagtataagcggatttacatgtaggaaaatataggaagaacataaatattggttgaaaaattgcatcacatttttaccaaaaaaaaattgcatcacatgcatattattcgcatgagatgtttaaagaaaggcccaccgcacgcgagtttaatctccaatggaaagacttacagaaaggtcaaagttctttatcaacagacaacaggatatgtgtgcgtagattgtaaaacacgtagttatctatacataaactaattcttaaattcgttatgtatagtttttttggcaggaaaaaagcatagaaccataaagaagaagaacggttgaagatcacgatctattcatgaatacgtgtcctcagctttaaaccactcacatggacggtttaatatctaacaaagcattgtttttccaaagatactttattactgtactaggcggcaatccagctgataattagatgaaaactaacaccatttaaataatttaaagttaggtttgtaccaataataatgtctaattggacggcttagagaagaaaaagatgggacgtacgtgcacgtgcggaccgacgaaacacgttgtcctctgttcacataagcaatggctctcggctttctaaaaatatctctaactatgcagtgaattacttgacctaaaccatgtcatttcgtgcaaccccaacaaattcctggcttcctttttttgtggttcatcaatcttttcttaggacaaaacgttttttttgtttatgtcagttaataaatgatcaagtcgagtctcgttgacaactagatatcaacgcatatctggtagatcactataaaactcagattatgggtgcatgttttggatattaaagcaaatatgtttaggtttggaatatcagggtatataaaaagatatagtttttgttcttacggaaaagaaactcaaattaatgaacattaggcttgaagtcatataatcaaacgtgtaaatgacattctttagtaatgattttgtttcccgcagtttaaaaagaaatctcactcatgactaatgtctacaaaagtagacaaaggattcttagttgattctttagtaatggttgaatagagctgaaagctaaagtcatagcatacatttggtcactttcatgaatttacatatatagataaaaatatcaactagttcaataagatatgattgttttatcaaacagaacatcatgagttggagtcttgaaatcattttaacctgttttgctgagagcaaaaatattgatttaaataacaattgtgagataggcaaataatctcacgtcttacttttcacatatataatacacatatagttcatatagtgggtttgcgttaaaatagaaataccattttcatccacaactaattgataaaagaaacatttggtatcgggatctaaacgaaatattcaccaatcaaatttaattttatatatagttttataatgaggagacgagaagatatttatgaagacaattattaattatgtatgtgaatatgattcgttttcttttggatttatagagctatagtagcaatccgtagagaagaaatctgaatcggatataacgccaaaagagagatcatatgagttctaaaaacttaaccacgacaatgttatctgtccatattatccatcttcgcacttcattttgttccatctcttgtccattctctatctctacatgacattacgtttccttaacatacatgcttccattatgtttctgtgtaaaattaattacggttacattatttattgatttgcattacatgtatgatttggagatgcatacacttggaaggagtatacgagcatgcgtgacaactgacatgaacatgtgaatatttaagatccaaacttccaagtatcttataattcaatcagaatagaaactttaaattataactctttgttgccaaaaaaattataactccttcagggatctatccacaaaatccaaatatagcacaaactaataattagtttatcagaatgcttaatgcttgactattaaatatttcttctgattcttttcccttcaaacaaaaccacagcaaccaaaattatcattaaaaaacgacaattttaaaaccttctctttctccgggaaggttatgttattatattattgtaaatcaaaccgagactttggtctctggcacaagtcagttatacggctaatgtcacggccaaagaagaaagtggtaatttagctgatgaagatagtaggagttttctccagcttatgactcgatctccatatgtaccagctcacgaagccggtcactggtattcctttggcgtcctgaccaaataatctatctcaaccacattgcttacgagtgaagttcattcaaaaagaaatctcgagtcaaagtgatggatttcgttttaagaattttccttgagctcaatgagcatttaaaatgtcccaggccaaaagttcttttcttaataaaatttgtgaaccgaaacaaaacattcttctcttaacaggtctttgggcctgctgttgaaagaaacagatatttaggcccatatatagtaaaatttttatggggcttatagaaatcagatatgagatattccataattatcaaattagttcacgagaacctcaagtgataggtagaagttgaataagattatcagtccagatgaatgccttaatcttgggaaagtcatcacttcatatgtctgagaagacgtttactaacttcaaagttttgtttgtaaaaaaaaaatcaatatgtgaaatcaaataaactgcatgaacacacacaaagtgaagtatacaaaaagctgaaatctagtaagattaaataaagctgaaatcgatgtagaaacagaaaatacaaataaaggttttatttttgagttatttttattgctctctcagtatacatacattatttgtaagcttgcaagtaaaattaagaagacaaaaaagattatcaccctctcaacgtttgcgtcctcggccgccgcgaggtggatcgtgtctgccgttagctgaaggttcaccgtagtcgttggtgctcaccatcaatgaccgttctctcaccaccctcatttcattttctgtcatatatgcatatacgttacaagttagaacatagtgagaatataaaatgttgtacataagaacctcttattaacaaacgatttattaattaagtatctatacaaacgtcaataccctcgttttcattttgttttaactacatcgacatgcattcataatcttttaactttatttgcacataaatttataaacgtatattgatatatatgtttcgatggttgtgttataaacttaaatttataaacatatattgatatctgctaaaaagaatagatttaaacacacccaaattcgacctttttgtgtgtgttggatgtcggtttcacaaatcgaaatctttgcttggatttttcacagatagtcagatacgatggactaagatccatttcaacttgctattttatgcaatttaatattatctgtaaacttcaattatatagtcgtgatcttatctgtcattgtctttttcaaataatgtcaacgcttttgaagtgtgaacacaaattaaatatcaagcttttatattacatggttgtactttacaaaaactcataatacttcaaaaaaatatttaaaatactttgttttcttcattagatttatagtttataattttatatgacgttttcttactggattcgtcgttatcacagatatgttcttttaaaagaacaagtcatcggcgaaaggaaagacaatctcgagcatcgtgattcatgtttgcttgaatttgaatacaaacaagctggaaacagagcgcataaaactaaggatatatccaacttgttttaacaatatatatttcaacacttattcaagtaataattgtaataatttagttgtgggtttctgtagtgatttaaaatgaaaggtcaatgaagttcacatgaactaattagtgtgttattcttttgttatttgtatgggttcatcatgtgttattcttttgttaatcagagtatgtatgcatatctagggataattggtatcatgtaaatacgaaggataaatatacatacaattatttattttgcttgtgtaattgagattttcttgttttctttattaaaaaggtaaaaactgttaaggctttcttcttctcctggtgatatatttgaacatactcttaagatatacacagatttacagatatagatcatgtgactaccaccacatatcaccgatcagtgatccaataattgtggttgtaaaatatttgattctgagatctcatccaataacacataaaatagtaaactagattagttttaacgttaaacaaagatgatatatgtagttattagtgaagaaatccttatgagttgttaacaggatatggattatgaagaacttgttagcttatatatagtgcttggatattagataaccaatacatattaccatacaaaaagctagtaaacacttgaaactaatagagaaacgaagggagggaagaagagtatacctggaaatgaaagactgaggcgagcagaagaagagacgaaagcaaatgtgaagaagagtaacaaacataacacaaccgaggaagatgatgcataacccattctctctatatatatatttctctctctcctcccttcttctatatatatagaccacaaaatgtctcataccggcccttcgttttcagcctttctcactatttaatcattttgatttttattaatatacccgcttccaaacgtttagtttttacataattgcgtttgaaaggaacatattctctataatctaatggttttgtattcaatgcgtgtatatgcatgtgtttgttgttgacaagcacaaaaacaagggaacatgattgcatttacatacggtaggtttgacaagactgaagtgggatccctttaaaccatcaacgaattaaaattcattttttcattgtattggttacaacagaactcaaatgccagcttaaaatccaacccattgctatttttgattttataatagctttagaggcacaatgattccaaatccattactatttcttattctaaaatagaaattactattttttgccaaaaaaaaatagaaattattattttgtcctctatttatagaggaagaaataacagtctctatttttactctatattttgaagattgctattataaagaaatacattagagtaaacttcacctttttataaagattttctattttagaggcaaaaatagcaaaatacattggttttagtaatgggttttagtagaataatttaatactttcattgtacaaattaaaaaactttgttagttatcacatacattcaattaggataatcataacataaaaacaagtacagaccacccgagtctagattatcaagaacaagaaagcattatatgtctggttttgtacccccatcaacttaagattctcttgaacataggcaacacacaagtttacacatacatagcataagagatccaagtacttcaagaaagcataggatcggataaatcggaaaatacatcatcgttttttgaaaccatatttcttacgttcatagaagagatcggtcttggcactcccaaggttgacgatcttggggcaaccatctctgtctttctcctgctgcgtacactctttgcagtagtaagcatccgagatcccaacacctccgcagataacacagcggccttggaatgacccgtagttgcattcgtcacagatacgcaccagagtgcagggacgcacataagaatcacaaaccacgcatttgccgtcgcatttctcgcacagccttccgatggcaatgcctggttgtttccggcacatgatcagatcagggtgatgctttgccatggctagtgaaacacagacctgcacacataagtcacttgtcttgagctcatatgatcgtaaagagtacaaaactagaaactgaagaacaagaagcaacttaaagtcctgttttcacttgtgtctgaacaatcaattaaaagaaaaagagagtaaaaaaattggaaaataaagtttgtgtagcagtgttaacttctcagaggaatatcatcgaacaccttacatgcacaagtctcagccgaacattactctttcaagattgcagattctagagacatgatcaatcactctacgaaatataattaataatgggctgagaaaacaaattgaacaaaagaaggaaatcaagaagctatcacaaaccctaaaaattcaaaatcaagaaacaaacgaagacgataaccaatctggaggagtcctctttagagataaaaaaaaaaaaccaaagcttacagttaacgggagatcaaactcgagcaaatcaagagactgttgcgacgagaaatttccagagcgccaaagatcaaccaaccaagaaaggtctggaacgaacgaggcaaggaggaaatttatcacgagtagagctttttaaatcggtccacttgttatgggctttttactttgggcttacaaactcttcatcaaaccaaaccaagccggtaagcaatgtaaaatccagggcctaaaccaaaccaggttaaacagcaatctgagttgcgactaaaagtgtcggtctcggtctccgtctccgtctcagacccaatttttatttcatcagccgttagctttgacttctgactagcataacgtgactttgttgctacaatggtacacaatatacttctttttttaattgggaaaatcgcatttttaaccttcaaagtgacattttctaacactttaaacctccaacctttttcactagcacttcaatacctcaaccctcaaaacttatcatattaaaccttgaagtcgtttcccgctcttaagcctccaggcgatttgacggtaatgttcacgccgtcatcctcactaaaaacgtgtgtcgtttttttaattaaaaaacaccagatacgttttttatcttttttatctgttctaaatcgaattggggatctagggtttactcaaaatcaaaatcagaaggagaaagctcgatacttggcgacgagcaagagattcgaacagagtacgtcgtctcaattgatttgttaagcatcttagtatagcaagttgtttctgggctttgtttttcacttcataaatcatgtatatgtgtagatagcgataattgtctgagttagaattggtttcacttcgtgaatcatgtatatcaagttgtgtagaagctcttttacatgtttatatcagataatggtgttgtatatgtgtagatggcacacagttcaagttcatcaaacgttgtgtacaaaaacgaaaaaggtgtggtttgcaattgtaactgcttagcaaacgttgttcaagcttggactgatgacaatcccgggaggaggttctatagctgcgaaaaacgcaagactggagatgaatatgattgttgtaacttttttcagtggtatgatgttgagaagcctcatggatggcagcgtgatgcattgattggtgctagaaatgttaatcgccaacaaagagaggagattaagagtctgaggaacaagataagagcacttagggaaaacatgggaccaaattcaatagatttgaaggaaaaaactgaagcatgtgacgcatgtgaagggctcaaaagggaggtgctgatactaaacgagaggagcagagtgtatcgcaatgttctcataacgtcatcagttggattcactgttgttcttggtgtgttcattggtgtgttgaagtggtagaaggttattcaaagttgtttgatgattttatgactatgttatgactatgtaagctatttgatgttatgactatttatgcttgtttgaaggtgttaagactaagatgattattatgtttcaatgttatatttttgtcatataaagtaaaaaaacatcaagatcataaaaccgaaccaaacaaactacattaagtcatgtcatgagaacaacaaaagacaaattttaagtcatgagaacaacaaaagacaaattccaagtcatgtgaacaacaaaagtcattgacacaaaaaaagacagattccgagaagacacataaacaacatcaagatcatacatagatttaatcactcttgtggaggaggttgtgggtttaggtcggacctatcataaactcgatctccaagcacctcaaaaggtcgatttgtgaatggactccataatgtcccaacaccatgaggaatattagttatcttccttaccttcaaaggaagtcctcttggagctttcttggcatgaggctttggatcagtggatgaaactgatggctgtggagcagtagagtgagttggtatctgagaggatgattcagcagcttgaacaggttgagaagagcttgttctttttcttcttgttgaaggaggcttaggcggaccctgaatcaaaaataaatgttaacatagatgcattgtgtataaattaaagagtatacgagtaacttaccactggatgtatacgaggtcgtacacgtttgttctttggaccctcataaaccacttgttcatttttgcagccacttttaatgtgacccatctgaaggcaacggctacatttgggcacacgtccgtgtcttgtcgattttccagcgttttcaaggtcttcaaatggctcttttctcctctctcttgttcttggtctacctcttggcttccttaactctggtattcctattgatggttttcctagcctcttccacaagttttcaccattgacgggcttgatgttctcgttgtatgttttcttcatcttatgggtgtagtaatactcggatgtatacttcacagggtcttcttgattatcatcaaacacacagacatcatgtttgcaaggtataccagtaagatcccatcgcctgcaagcacactgatgtgttgccaaattcactgtgtaaccattatcacactcattaacctcatacaaacttgagctgcttcgtagtgttgaacaatatttcttggcaatccttgctttctccaataaagcaagtgtgattggtgtaacaatagtatcccacttatctgccataaaccaccgccttgaattcctcttcatagcttgtcttcgaatgtcctccaacatagttatcacgggtttcgcccttgccatctttatggttctgttgaagctctcagataagttattatgcacgtcaggacagtgtgaatcaacactgaaatatgctctacaccacctcttagggtctgtcttgagtaactcttggtgtgctacaacattatatgcctctaatagactcaacttctcttcatactctcctttagtgtagctgtaagcaactccccaaaacaaagatttaaactctgatctcgcaaacccaagcttcttccaattcgcataaatatgtctagcacacatgcggtgttctgcatcagggagttccaactgtatggcatgaacaagacctttttgtttatccgaaatgatggtcagatccttgccatttcccaagtcgagatccatctttagcttcttcacaaaccagccccaagtgtctttgttttcccctcttacaactgcccaagcaatgggaaacattctgttatcagcgtctctaccaactgctgcaagcaaatctccatttaaatcccactttaagaagcatccatcaagacctattacaggtctacaacaactcttccatgattcacgtaattccttgaagcaaatataaaagcagtcaaacatctgaacaccgttagcctctcttgtgcataattcagtgcttataccaccatttgatctatgtaactctgcttcataatcccatatcttgaatagtcggattttcatcctctgattcttcaggctcatcgtcttcctttggtctgtcaacatcttcatcttcatcactacacgaacgctcgtcttgttcggtgtttggtatgtgttccacgaacacttcaacaacatctactcctagcttccccgcagaacgaagtatacgcatctcctcatccaagtaatcatatgcatatctcaggtctttcatctcctctttctcgaacttgaaccaaagcagtccaattggtgctcgtatcagtgaatcttccttgcaaaacagactgaacctctcccatgtgatctcgtcaatcttccactccacatttttggtgcccgtttcaccaacatacgcatatccttcaccatccttcttcattgaacctccaaaatgaatctttaacttcatttatgttgcttccctgtaatcaattgcttaaactttagacaatttcgagagataaaacgaatgtaaaactcgaaatttttgaaagaatagatcaaatcgatgactcgcggacccttaccccatatttgctttgattcacgaaatttcctatcacttaatcgagctttctccttctgattttgattttgagtaaccttagatccccaattcgatttagaacagataaaaaagataaaaaaacgtatctggtgttttttaattaaaaaaacgacacacgtttttagtgaggatgacggcgtgaacattaccgtcaaatcgcctggaggcttaagcgcggaaaacgacttcaaggtttaatatgataagttttgagggttgaggtattgaagtgctagtgaaaaaggttggaggtttaaagtgctagaaagtgtcactttgaaggttaaaaatgcgattttcccttttttaattagtatactttctctatatttcactccaatagcatctccaatgtacacctctataattttttctaaaatatagatttctattataaaggtgaaaatgctccaatatatgcctctataatatagttcatctatttatacgggaaaatatataaatatattttttctatattttcttttaaaatagaagaactctattatagaggcatacattagagcattttcacctctataatagagtttctctattttagagaaaaaatatagagatagaattagaggcgggttggagaaggtctaatagtataactctttggatttgttccatggttcattctaacataattactagatctcgatccccgcaaccgcgcagatttttgttttcatttatttttatataaatattttgttttcaattctaaattggtatatattataatagatgcgtctatcaatttttaaagcataataaatttaccgtatatttttttctttgaatagattgtttcaaacattcacatgtatttgtattttcttctatatatatatttcagattattatttcattattaaaatcgtaactatatatttaaagattagtaaaatattgttttattgtcatattcaaagatattgtaacatttcacaaatttagaaagtttttaaaaaattaaaattttcgcttcgtagatttatattatcgagtaaataattaaacatttggtttttgtttaatttttaaaataaactatataatttaaaatttgttttcattggtttaaggtagtaaatattaataattgttagataatatgatttttgttattttaaaaaaaatatttataattttaaaagttaacatcgacaaatatttaaatatttaacatatggaggtatagtatattacaatattaaattatatatatttaagttatactatctataaatccaatggataatctattgtttaaatccaattattgatagtccaataaaaatttctggtaggccaaaaatttaaatgatataattatactttaaatgtaacatgacttcataggaataagttcattaggtcaatttttttaaaaatcacatatgaatcaagttatgacttctattttaatatataagatattttcacaaaagatagagatcatctttttctgcgctgggaatggagtgctgatctttggaacatttgtctgcgaagaatggggtattccaatgtggagttccataaatggttagccttctacgaatggtaaggctgcatgacaaagttgtgccaaggcttctcagacccttggtagtctcaacaacaatctatttcatttgctctcagagaaacgagcgctattatgttaatatctcatcgcagccaacaatcattttcaagctgcttgaccgtttcattacaaatgcacttctattcattagaaatcaaaaacagagctgcggactgatgcaagtatgcaacattggctttccaagtatgcaacattggctttccagggaattaaaaccatagtctgaactatacccattttaatggaatttacatatgtggcaaaaaaaaaatacaagtcaagaggcagacatatatacttcttttttttaattagaagcaagagttttaaataaactgaaatttttcataaaatttaaagtaattatttacaaaaattaaatttaagctaattattaaaaattaaaaatcaaaattaagcatgccactgaatataaaactatgtaaatgctaatctaactagatgttgtggctgatttgttgaactttgtagaaatgatgctgataaaaatgttataaatgatctgatgtaactagggattctttttgttttattttgtaataaatgaagaaaaatatttttaccattataattttttatatatcttagaaaataaggtgttcgttatatcccaacagtagtttttaattggactagatctttttgtgtttgtatatttttcgtcttttttatgtattggtttatttttttgttattttattgatttcaaatatttttttgtctcaaatttcttatttagattagttaccatttttaaattttgtacttctgaatatttagttatactctttattttcttagttattttaatatagtattgcatatttagatacaaaggaaaatagtacgtgtaaaaattaaataatgtagacatatttttccttgtctggttttcttcatcccatgtaaaaatccacctaactttgatgtaggtttttgtcatgttccaatatacgtataaagttttttgttggtaaaaatttacgtataaagttgtttcattattttttcttggagcttcgaataacttttattgacttaccaaaataaaatcttgagtgattttaaggtgaaaactaacatttctgttaaacagttattatttttttacatcgttaaataattatattaaacattgcatatggttatttgatataccaaaatgtattatttataactgagactatgagaaacagaatagatgttaaatgcattacttgtaacctttggcatcatctttgctatatactcgaattatattatattaagtattttattggtctttaacatttattttaatcctgttctaaattgtaatgtattaattattatttttatatttgtttgttttttttttctcattgtgttcttttcttacatatgttttagattaaatatttttagcatgtattttaaaaaacctgcctttctaaaattaaagttatgttgaaccaaataaagttatatatgtagtaaattaaaatatacttaaagtataaattaaatataatatatattatttaattgttgtttaatctattgtgtttgttatagttaataatccacatctaacatatttttaatgttggtgggaaaaataaccttacacatgataaaaccaattaaatatgaagtacatgatatcaaatgtgccaaaaactatcctgaaaaactaacattaatcaaaaactaaagtagattatcttaagtctttactgatgaaaaaaaaaaaaaaaaaaaaaagtctttactatatggtacacgaagctactcttctaaaatgatttttttctaattaatatcactttatgaacaattttagtttacttattattgtattgttttctactatatcctcaaatctaagttcaactggaatttaattttaatgaatctttgtattttttattttatttgcgttggcaaatcctcctgttaatttttttttaatgtatatttcatattctagtaaataacttttagttccactcattggtcaatagaaaagaaatatttatttaggaagctaagacgaaatctgaaccatgcaacaaaaacaaacataaagtcattaaaattcagagacaatttataagttaatcaacatgcaatagaatcagcaatataaccttggcccaacaccaatggtgatgggagtgatctgcttcactacatccggagagcctgcttgcgtacacggtgtgaaaattttcccatatgttggttccttaattatatataacaaaaaaaacatgcaggttcctcattcgttagcgtaagctttgcagccacatatgatagatatgtcaaccaaatgtcaaactctgaccaaattcgtttctaaagcacataacaattaagactggaaactggaagatatatattcactatcttacaatgactttcataaggtgctcacttatagaaccaagtgtaatataaattactcacatatatgtcttctactcacatattctcacctgatccctgagcaggtggtttgtattgatctagcagtgtgtgtgaaactggatttggttggttgagttggctgacttgagacgtctctcacggataaactttggctttgttccaaatcctattttgtaattcatcacacaaacctatgaagattgatggaaaaactatcatgaaatatatcaattgatgaaaaagttagattaatcttaccgtaatacatttgaatcagattgaaatagatatatcccaccatataaactaaacactaagctgcgtcccctagcttctgactcctagtgacaataacaaagggaagacataagatggacattcatatagtgaaatctgtaactataccaatatcaatagcttcagaaaccatttgtagggtctgtggatcatatgtatttgcagctgttaaagatagcaagatgattccatggaccacaatcagcttctggctcacttgtgctccgattttctcacaacttttagcccgtgaaccatatacgtttgtcttaattactatatagaacaaagaaaatcaatatctgctaaaaatatattttctttttctgttgattatgttctaatccatgtatttttagtttataaacgttgaatacaagatatcttcatatcctagggatgcttatataatgcatcctcaatgttaatttaaataaacaaattagagagggaagtaaggcaaacgtttcatgaaaaaaaattgtagtcatcgcatacctcttgtcaatcttccagatgcaaagtagatctataccagccattgatctccactgttctgcgcaagaataattgactcacattccaacactgagtcctctcaacaatacgtagaacaaagaacagttcctatgggaaagcataccacttagaacattatcacgttagtttggcattaatcactttgttaccagcacgtggtgctttacttacctcaacttatatcttttaattcgagaagtcatctgtgaaaggttgcaaaactgtatgaccagctggcatctttgtgtcgaaaagtgtttgtgggaaccgtagaagttcttgctgctcattctcaaacttggccagtttatgcaaaccaattcccctgaatatccaccataactaaagagttattttgctattttagctcttccacggacctagaagtgaaaccacaaaccataacattgttcagaactaccaacctatatagtgcaaaggtcctacacatccttggtattatagtcgaattcaaaacacgcaccgtttcattctgactctgaaagggattcccaggcctccactgcgaaccagatacactatttgagcctgagatttgtgtctttgatatcaaagtttgcttaacacatccaaacagtgctcacctcggaaatctctttctattatgatcatcgacatcaagaaggaaagatcaatcagtaagggttctaagcaatttcagatataaacagaaacgccagtggtgtttagatttaatttagaaactactgaatcagaaaagcgattattaagttaccggcaatggaggagcaacaacgtaaccaatattggaggccatggcgggaatttgtgttctgaaaattgtcatcgtctgtgaagaaacattggattttgagtgtagccgtcgtctatatagtgaggatggcgagaaggatggaaaatgaagaggcttcaatataatgtcaagaaggcttaaaaggatttgtacggtgaaagaaaaagagatgaagagctagatagttatggtctggttcaagagaaaacgaatggaattgatgaaacaaagataaagaaaataagaatgtgatgatgacgtggcaataaactctgacctaatcggttgattttttaatctgagctggcatcctctccattcagcatatctgctttttagtattgttagattataattaaatttaaaattaataaagcatatttagtaaatttaaaagttgtaaaaaatattataaagatatcacgtacaatatcattttacataacattccaaatatcttatttttggaaaggattctgattcaatctggatcccgcataataagcctcagccctgttcctaacaagaaaggtctggaacgaacgagggaaggaggatatttagcacgagtagcgctttttaagtcggtccacttattacgggatttttacttttggcttacaaactcttcatcaaaccaaaccaaaccaaaccaaaccggtaagcaatgtaaaatccagtggccaaaccaaaccaggttaaacagcaatttgagttacaaccaagtgtcggtctcggtctcagtctcaggcccatattttatttcatcagccgttagctttgacatattatgactaatacgactggacacagattggatatccagattttttaagatatttttgatttgattcgtatgttacagatatctaatttattgatttgctttgttccaaaaaaatacggatattcggaaagacggatatccgaaaaataaatacatagttgcggatatttacgaatacctacggatatctcatccattttgattaatacaaacaatcttaaaaattcgatacaaatttgtatttaaaaatattttttgcatgatatataaaacaaaaattaaaagaaatagtgaaactatatatttttaaaattttaaaacttaattaacaattataataaaataaaacttaagaaaaaattataattgttataattatttctcgtatattttatgtaatacttttatataagtaataatgtgaataaaatttgtcaaatcatatgttagaataataattatataaatacatttaaaacttttaagtataatcaagatatacatgtatttatatattaccggattggagcggatatccgcttcccaaaattttaatatttgtgatttacttcgattttaacggatattaattttagtatttgttttccttcaaaaatttacggatatcactacaagaaaacataagtttaacgacggtggttttcctcgtgagtttgtcgtaaaagagagtttacgaggaattagcgaggaatcacgtttcgtcgttatatgttcgtcgtaaatcatattttctcgctaattcgtcgtaaactagcgagaaaaccatttcgtcgtaaagacgaagaaaacaaatcgtcgtaaagaccacgtagatagtccatgtaagaatgtcgctagcattcctcgtaaataccacgaaagcatttcctcgtaaacgacacgtacatatctcgaaaatatttcctcgtaaaattcacgtaattaccttgaaattctttcctcgtaacattcacgtaaataccttgaaagtatttcctcgtaaaatacttgtttaccatttctcgtgatttcctcgtaaactttcaacgtaaataaatcgtagattagctacgaatctacttcgttttattgttttacagaatttaaaaatataattaaaaaatttaaaattattaaatttattaataaaattaaaattttaaaaaaatacgcaaatattttatatataaataatttttgaatttataatacaaccacgggaaaaaaaaagaactaagagtcgtgcatcgcccggaggaattcatcactcctcctgtctacatcctcctcggcatgtgtgtcgtcggatggttcctcgcctgaaatgagattttgttgtcgcatgttcctcaacatggtctcccattccggatttgtggccgctataacgtccaagaagctctcgagtccacccacacgagctctgaacgcagattgcttcgaagccaactcgttatgcagctgagtgacttcatcatcccgtcgctgaccataagacaatgtcgctctcggaacatcgttgacggaaccaatccccaacgtccatccctttttttaaagacaatcttaaaacaaaaaataaatattgttagtaaaaatttaaagttaaattaaatgaataataaaaaattaaaattttagaaaatttacctcctcgtaaatcttatccacttcaagtgtggataaggtgacgagtaatccgtcggtggacagctggatctggtggtcttcaacccgagcaaccaagtcgttgtagatttgcttggacttgccatctagaaatacgcctgccttgttcttgtgggtcctctcgtaaagttccataagagacgggagatgtgccgtttctttggccttaaaaacatttaagaaagttagaataaaaatatatatatatatatatatatatatatatataataaatatatatatatatatattattatntntntnttnttttattatttttttttttttttttttgaagaaaacatatataaaccgaaatcgaatatatacactgcgatgcaatcacacacttacaacacccaatttttccatttacacctctagacacacaggtccgtgtctaaccacctaaatgttccgatcctacctaaacagtcggatgaaccatgtctaccctaatctctccattgtttttgcacatgtatgcacatataatcagtgtgtaagaatgcatggagatgaaataaaagtgtacggtgtaggtgtggtaccaaactattgatgagtctggccattcaggattattaaagagtggtaaaatgtggtaaagaaaatcctgaatgtgtatatggtgtaccgtttcctgatgttgattcctggtcaaaagaaattaaattcattaatggtcaaaattatttgagtcgattacaattcaccgagacttgataaaagatttaaggagaggttgcttggtcaagtagttcctcggtttgtctgcgctaacagtcctgaaaaatggtcaatatgaaatgtaatacacaacacacaaggaaatagtctaataatcatcacagggtctgagaaaaacacgtagtagtttttt

SEQ ID NO: 13 - DNA, 10653 bp, Brassica napus
aggtcgagtatctttgtagtggtcgagttgcgggcgatcagattgttcttatttgaaccaagagtcaagaatgccactaggccatggtttgacaatgccttagattgatcagatggatgttttggaaccaagcacgacggaatagaagcacgacgggaaaactcgaaattggacggaaaccctaatttcggtattatggaagtttctgatcaagccgaagaatcaagaaatatttaccgccaaggtcagagttcagattggagtttattaaaaatattcagctcatcagaatgggagtagaaaaatatttgggattgatcgcgggtcagaaatttaccggaatgaccgaaatcagaccaatggaccgaaaagctcgaggtggctcgttgcatgggttcagaacgtggtgtaaaccatctaacaagctgagtgtctacagaagctcgaggtgtcatcgtacatggaagttgtacatgcagcctgacatgtagaagcacgaggtggatcgaccaagcacgaggtggatcgaccaagcacgaggtgtctccgcgcatgcaaccgaagcatgctgatcgacatgtgtgtgctgctgtggcgccttgcatgagttctagtcatgcagcctgacatctgggaggagtggtggcgtcctgcatatgtcctggacatgaagccagccatgtggagcacgaggtgccgccgcgcatgtgtccggagccatgcgaagcgacacacaggctgccactaacctgaagctgattggttgctgtcttctataaatagcccacgaccccagctcatttcatcacatccatacctgtacaaaccaccttagaaacgtgagagaaaagtagaaaaagaaagcaagagtttccgatctatttcgagaattttagagagattgcgaggtcagttctctactgatttcgagtcagcgcctagggacggttctgtccaactgaattcgtccagaccactcagttcctttgatgatcaactagatatgctgtccggagttagttcagttctacgggttcagatcagtcgaagttttgctcgatactccgccgggaagtccgaagaactgtccagaagctagaggaggttctgtccgagtccatatcagcctgtcgaggcctgtcagtttcttcatggtgaagccgaggttgtgtccaagacaagatcagtccagtccactccagtcatgtcgtcaattgggttttggccaagtcttctccgatcaaccagctgcttatcagcaaagaacactgtgagttatgatcaattgattgctgacttgttttcatgcaggttcccgttacttagaagttggatcatggcaggaggtcggctctaactgagtcacggtttgactagttaataattgaggttatgttgattgagttgatagcatgctggttattgcttgagaaccgtagtagcatgctaatggttaggttgattggttagttagcgaatgcggaatgcttagatgatatcgctaagttgtggatagttagatattctggaattagtttttatgctagattctggaatatgattgattctgttaatttgcgattaatactaggaaccttgtgttattttaccgggtttagtattagtcatgtattggccatatagcatttgtgtaaaccacaatgctatgcatgtttgaggtggattagtgtttcctcgacctcgtacccagcgggtttaaggttactcttccaactccgttgtcctttttgcaggtcgctttaggtaaggatgatcggatagcttggtgctcgacgttaggaccgccggagtagatttcatgccttttgtaaacggtattgcgttatgtgttttgttggctcgatttggcattaggccgggcccagtcttgaattatttcaatgtatggatatttcttgaatcaataaagtaaatgttttatatgcgcttcatgagtactctgatatctgactagtccggtctaacacaacgttaggtcgtggtacgggttgaaaagccttaggcctcgatctaacggaaaacgctaactctaggtacgggttgcaaagccttgtgccttgacgcagcaggacgagttagtggaggaactggtcgaggtcgtggagtaaattttgtgactctggccggatcgtccctagcccgtcacgtagcgcttccggaccatggtgttgggttggacggtcagtcatgttcttgtttgattgttggctggccgattggcctttcatctccaacccttggtgtgggtcatccgtcggtcatgttcttgtttgattgttggccggtgggtcgacctatacctaggacggttcgggggtgttacactaatcatgtaagctcattcagaagaaagtttatagtttttttatatagattttagttttagcaggcaatgttcatagattttcttgcaaaaccttgtccacaatacgttttatacttcttatccacaatttattttattttattttaaaatattgatttttatccaatatttctcagaagtgcttcggactcatcagatcactttccgataaacagttccgacaaaatttgttaatggaacttttcacctaattgtagaatacaaaatcttgtccacaaagttaaattaagggggtgtattcaatttaacattttatgtgatttgatttttaatgggattttagatgatttcaataagttgcagagatttatgtgagttttgttaaactactctagaatatcatctaaaaccatgagatttgagttttaattttttttaactaagaaactctacctaaacaccctaaaatcatctgaaagctttaaaactccacaacttaaaatattttcaataacaatggatttaagagtactttacgaaatatcaaattcaataacattgtattttaaatgagtttttaaaattcatgtttgaataacagtgaatttgttattttaatacaaatcacctaaaactagcagtggaatacaccccgcctaaatattcttttgttcccttaattgtgttctcgtctataactcattcttgtaacatttgtctgtacacaacttacatgtccactatttttgtatccataatgttcgcctgtccacataatgtttgtctatccacgtaatatttatccaactgagtaaccataacatccttacatggacacgaaagcatcaacaaccagcgaacatgtatttgtggacatgatagaatccacatccatgaaatatggatgactgtaacttgctaaactgttcattttaatgtaattgttggattaacagtttttttacgatcttgtggtccttatggaagtccaactatcaaaaaacttaatctaataaatgtctaaaagctaactggaaaaacaacacaaacaatattccaactttctgtttcgtttcagtaagagcaaaatagtccaaaaactctctcaatttccgtgaatgtatgtagtgctgggttcgcgggtcaacccgccccgacccgccccgccccgccccgggtcgaatcattttttcgattcaaaaactcgacccgcataacccgcaaacaaaaacttttatatccgcacccgccccgccaaaacccgcgggtaacccgccaaacccgcgggtaatattaattatattaaaaatagttattttaattaaaaatgattattttctaattatataataattattttaattaaaaataattattttttatttatataatagttatttttaaaaaatactattaaaaaatatatttataattaaaattatacaaatatttattgttttttatatattttacgaaaaaatgttttttttcaaaatttttttttttttaattttgcgggttggcgggtacccgcgattcaaattcggctgacccgcacccgccccgctcaaaataatcttgactcgcacccgcacccgcgatttaaaattttcaaatggttcgacccgcacccgccccgcggcggatcaaatggggcgggacccgcaggcaatgattaaaatttccagctctaaatgtatgctacaagtggaaggtagttttgggtgcaaagaaaacagcctattaagtaatcaactctttaatatattgggacgaatgagatgtttgtaaaattatttaggtccagatacttggcgcaatttaagaaggcttttatatatttgggccgaaaaggttcgcccattacttaaaaaagcgacaactccgtgacatattgttgttgtgctgggacccaaaaacggcgtgcattttgtcgactttcagtggaactggctttttctttctgtccaaatcaaaaaagttttaaagatccttttgattgcaaccagagaaaaagataacaaaacttccactttttgtaacgtaaatacattaataaaaaaaaggtttcacgagtacattttaaacttaaagcagaaacaaataagtaaaagagaaggagtgtttattcctaatagagctaggaagaaaagttaattgattttagatttgtcagaagcataaacgtagagatctggatctgtctcgtagaagacaatatcaccagtgtcactgacgtaatgatcttttttaatacttgcgaccaaactctccaccaagtgaatcggtattgctcctgacgtcttcggctctctgtagtatcttcctaacacatgtttagctgctctcgtctgtccacaattcattaattaaattagtaattaatcaccatttaatcaaatgaaactagagagagagaaagctagatcactcacggcatcgaccaagtgatagtgagggatttgtgggaaaagatgatggatcacgtgagttccaatgtcgtgatggatgttgttgaagattccgtaatctctatcaatagttgttaatcctccacgtaaataactccattcctattattgtatgcaaaacatcaaaaattaagattaatcaatactaaccattattgctttctgtacatttctttttaaaaattgatttaattaccttgcctctgtaccaaggcaacttctcatcgtgaccatgatgatgcaagtacgtgacagcgtccaaccacatcacaaagatctgaaaattttccaaacccttatgtcaaaaaacaaatttattattaataatatataaatttcttgtaataatatgtgaaacttacaatgtaaggaacgccatagactttgagaactgtgactggatcaacgaggaacgatagataaacaagagtggccaacattatggaccagcaagtagttgaagttgcaataagcttcctctcgcttggagcaaataaactactgtatgggttaaaatgtgacccttcttttccaggacttctgtaccactgtagttaaaatccaatcaaaattaatttatatattggcttaaaactcaaaatataaaatcatttgtaattttaagaaaaaatagaaattgtattttttttaccagatagatcgggtaagcgagcatgggcagagggacagtgtatctgagcatccgagtactatggggcaagttcttgtacaacttttctggcaactgaaatacataattataattaatatgactattactattactattactaattactattacggagtagtacttactagtattaaatattcattgaaaatttgtcattctggttatgtattcgtattaattcatgtgtttataagttttatactaatagctttcaagattgcagacaaaagtattacgaaaacgccaaaactgaaaaggaaaaaataacgaagaaagtaaacggatttcgaggagaatcatgttatgctaaggactcgaatataagtggtccatcgataaagttaggtactataaaagtatagatttttcattttctgagttactgcgtaacctctaaaaaaaactctctaaatagagtttactctaaatttaaagtttcaaagtggttttcttcgaaaacaaacttcaaacataacttcaaaattatttgtattttacacaatgatccttatttgttataactaagagcatgattaacctgggattcttaggatggggttcttaccggaagttaagaaactgtttcttaacgtttaactaaaactccactctaagaactccgggttaatcatggtctaatataaatccataaaaaaaattataaataactagcacatatataaaaatattacagtaatattaattaataaaaatttacattaaatatataaaattataaatagaaatatataattaaatattaaactagaagcaaaataccatattatttcataaaattattttcgtaatgctccatcttcggttacacaaaatttgtttagacaataattttagaggttccagagcaaatttaccagattattagtattgttataatatttaaattttctaatagttatgtcttcatgtatcttattttaaattttttattattacatttcttttgtaatattttgttgactaattatagtcttaaatattataaatcttatttaacatttttattacttttatgtataaaatttgaatttataaaaacaaattggaaatatttataatatataaaaaatttaagaattaaaacgataaatgaaaaaatacttaagaattataaatgtaacgtgtaattaattataatgatcaaaatgcaaaaaaaaaacttcaaatttgaagtttcgaagttcatttttgaaaaacaaaaaaatctttatatttgaagttataaaatttttttttgagatagatccgagaacattaattaccgctgaactattacacttgcaaattgttttttactacagctagaaaacagatctgacaagtggccggtctgacctcagactgaaaacataaactaataaaataaacatatagaatcctaggagtatgattattggggtttttaggaagaggttcttagcggaatataagaacccgtttcttaacttttaactaaaaaaattaagaacgtgttcataaaactcttatttaaaagctggttcttagcttttttagttaaaagttaagagacaggttctcatattccgttaagaaccccaccttaagaacttcaataatcataagaacttagacataagaatgaattcccaaaaaagaacaaataaataaaagacaagagaaacaatgagagtaggaaagattaccggaacccaagactcgtcgttttcaacatggccatggttctggtggtgtgtccgatggcttattctcctgcaaaccccaattacaaaagttatgtatttatttatttttgtgaaaatgaaattgtctctataatgatttaacaatctcactcattttatatttattttgtttttttagttgatatatttattgaacaactaacaatagagtgctctaacaatcccattcttttttttgagcaaaaaaacatttgatgctttttactaataaacattgtgcagaaataagtaaaaaaaactataaatcctcaggaaattgatgcatgtaagtctttttcgaagatgtttgaagctgatgtaaacaaataacaataagtgaaaacctaaaaaaaaatcaaaatctaattatacttaatgaactaagaaaactcaggaccatagataggcgcatatcatttaagaaaaggtttggattctttttcattggctgctaaagatttgatgcttttgaacagaaaaagcaacctcatatagtcacatgcattgtttaataggattcttatttaattataaaattgctactctagcaacaaaaaaaagttggtagcttccagttaatactgattacagtttcctagcattgcacccaagaataacaaacgaaaatgtaagaaatacgaaaacaagtactaataatttacatggaaatagttaataaatgacttaccaaccatggtaaggaacgaggatgaatgaatgaagaatgtgaccaaccacactgttcagcagaggaatgtctgagaaactcccatgtccactgccattattcaattttattttcacatcattatttaacataaaaacgtatttatcatttagtgcacaatttattttaacttttctacatttgttttaactcaaactctttaacaaggtaacaaatccggtatatgacgtgtcacttgtctaaatcacaaaatagattggaacacaaaaagaagaaaaaaacaatatatttttcttgtcaaaaaacaatatatttgttgccaaaaaaataaacagtatattttcttgatattatactatactataattataattaaaagttccggggatctagagaaagagaaacaaaaattgagaacatcaaaacgtagatccataaaatgcggaaataatattaattatagaaaagaagatattttgttacgagtctgacgactgatgagtgacgatgcttgaacattgatgaagaaaaaaatcttagatcctatattttcttttattttttaataattaaacatgaaaaagtaacctcaaaagaattaaatcttgaagtcagtgacgatactcatcgaacgtgcattcaagaaattaataaattgaacaaaaagagacaaaataattaaaactgaaaatttaatttaccagtcgtggccaagaacgaagatggcccagaaaagggttccttgggcaacccagtagagtggccagaggaaccagctatcaaaatacacggcggccatggccagagccgcgacggcgaaaatgtctctggcgacgtagctcatagatctcaaaggactcttcacccagcaatgcttaggaatcgccgcccttatatctccgatcttaaacggtggttgtgcgcttggatcaaacccttcttccttccgggcaccggaatctccgttaacattgctgcgctggtccatagcaacaaccatcgctggagagagagatttggacgaagtttctctctctagatgtgtggcctttcagtgaaatgtggtgaataaaggtttgatggattttttgggtgtgtgaggttggcttatataaagggagaagatgtatttatggacattgagaaaatattccaaattgttttttaatgattaataatttattttttatttatcaaaagaataaaaatggtaatttagctgtaacttttgtacaatgggttgggtgtataatgttccaaaaaaaagggttgggtgtattactctgttacgtcgttcaacgcaatgaaaccaaattggagtaaatgtgtttcttttctatttttagattttccttggacggaaggattgtaccaaataaatttatttgtgtttcttactctagaatcaaataccatatgtagatgcagtgaaatggaagacaaacataacgatcctctagcatatatattttgttccctaaaattttgttgattatttattgactaggataagatcaccttgggcgggatagacatcgtttatataaagtggttaagaaaatacatcgtgtatataaattatttttacatattaccatttattttacatgaaataataaaataataaatatatattaaataaattgaaaagtctataactattatgtatataattaagttggtgtaaacacataaatcaaaacaaacactcttttctatttaaaataatattgagataaaaaaatctaaaaaatcaattatatctatggtatataattaaatttaaatgatattaacatatagaagtatattttaaaatatctatccgttaaataatgcttcatactcatatagttttatgacaatttgtattttttaaactattgaaaataaaattttcaatttgatacttttaatagttttagtaatttataactgtttttaaaaattcaataaaaaatttgaaattaaaatattaagttctcaatatttcttcaatggaaatttcaaattaaactattatgttcttatatggtatatagtttaatttaaacgatagtaaaaacatatttttaatatgaaaatatattaaataagacattttattcatatgatttttatgatcatttatatattgtataacaaaaaaatttaagccactgatcacaaaattttcaatgtaatatttttaacagttttagtaatttatagttgtttaaaaaaattcaaattataacatataagaaaaaatctaaatttttattctatgattaatatgattgtttaatttattttttaaatataaaacaaaaaataatagaggaaacacaaattgttatcaattttttattattcaaaatcactaattgtcatatatatattgatcacattaaataattttgtagcttttattcaaggaactaaataaaaaaaattttggtacattaataattagttttgtagttactttaatgagaactactgtgtatatttagattgaccaacttatttctgtaagtaatccgagaaccattctagtgattagagatgacaattatggatctggaccgcgggcctggcccgtaaaggactgtcgcgggacggtattgggacgaggttttctaggcccgaaaatttgcgggcttcgcgggacaggtctttacgggactgggccttttgcgggatgggccgaaacgggtcttgcgggattacatggacccgcatttttt

SEQ ID NO: 14 - DNA, 23648 bp, Brassica napus
cccattcgaaaataaacatcaaacccaagaaaccctagaaacagaaagacaccgtcgccatcgccttcaaagaaatataaaaaattatattttatattccattaaaaattattgaccaaaaaataaactattaaaattttaaaccgctggtacgtacattgctaagacatagattaatagatgagcaattttccaagcttatctcgaagccttggagaagtaagttgaagagatgaactcagctacggcaaacaacaataccactacatgcaatccaagagtcacctcagaggttcaaatcctaaaatagcagagtacatggtactccgaagagaaaattctgccttgaccgtagctaggggaactagacgaaggttctgaacccgcaatcaacccatgcaaactctagatcgcccgctgtgacatgaagcataactctctaaaatcatgtgggaactggagagcatgccatagatgctcaagccacgaatactgatcgtgcaaacttacatttggacaacgatggcacagacacggacacatgtgcatagatgcatgaaactttttgaatttttttttgaattttttttttgaaactattttttagctctaggagactatatttgaaatatttagatgaaatatttaggtaattttaatccttgaagactatatttgtgacaaaaggttttttagggtcagtctagaaaatttatttttctttttaacctttgaaattgtatgtttttcagtgtataaatggattaataactaaagaagagtttcacgagtacatttttaacttaaaaacaccaataaataagtgaaaaaagactggtttattcataatagggctaaacaaaaagggggaagaaagtttaattgattttcgatttgacagaagcataaacgtagagatctggatcagtctcgtagaagacaatgtcaccggtgtcactgacgtaatgatctttcttaatacttgctaccaaactctccaccaagtggatcggtattgctcctgacgtcttcggttctctgtagtatcttcccaacgcatgtttagctgcttttgtctgtcacattccatttgttaaaatcagtacattagtaattaatcaccctttaatgaaatggtttagatgaaagtagcgagagagtgagatgactcacagcatcgaccaagtgatagtgagggatttgtgggaaaagatgatggatcacgtgagttccaatgtcgtgatgaatgttgttgaaaattccgtaatctctatcaatagttgttaatcctccacgtaagtaactccattcctattattaatcacaaaacatcaagaattaagattaatcaaatactaataatttttttttgtgaaacatcgtaatctctataaaatattatttgagaagtcggttttctatgtatcgctctcacgttaactctcacgatagttgattacactaatacacttaatgaattaaaaatattacatttaaaatactattatttatttttttatttagtttcctttttaaaattttccaaaaaaacatatacatataataaaaaggaatttttttataaacttaaaaaattatattttacttgtataatattaatttcaaatacaatctcacttttgttcactgcttatttttaagagttattaaaaaactaaaattaaaattaaaaaataatcattgtttgatcaaatagttacaaaataatcacagtttttaaatgttatgtttttatgtttgtagaacttaatggaaccataagcaaaataccaaagcaaatatgttttcatttttaagattatttaaaataaatttcagtttccattcaataaattaaatacataaagttatttagaatttataaaatattttaattactgtaaaatattaaccaaatgttacaatttagttcttttgtaaaatttatatatatatatgcatgagacttcagaatattatcgttatattaatttatgtaatttagaatcagacactttattttattttttatttcattttaagcacaatatatatattaagttatacataatctttataaaatatatttaaagttctaagacaacaaccacctaaatgaaaataagaaattaatcaaaattttaatatagttaaaataaaaaatattacagttgaattctgagatgcaatccaatttacccaaatgataactaaatcgactgtaaaaacaacaaaaccgattagatataacatatataaaatcatatttataattaaagtaatataaattttattaatataaatcatgcatacaaattataaactaatttaaaattaaaaataaataacaattaattattatagtatatttactttagaaatatttatatccgtacatgagcacgggaaaatcacctaggagttaatttaattaccttgcctctgtaccaaggcaacttctcatcatgaccatggtgatgcaagtaagtgacagcgtccaaccacatcacaaagatctgaatttcaaaagtttatgacaaaaacaaatcatatagtatatatattgaataataaatatataccctttatgatatactaagaaacttacgatgtaaggaacaccgtatactttgagaactgtgactggaccaacgaggaaggaaagacagataagaatggccaacattatggaccagcaagtagttgaagttgcaataagctttctctcgcttggagcaaataaaccactgtatgggttaaaatgtgacccttcttttccaggacttctgtaccactgcagtaaaaccaaagaaaaaataatttatattgttttaaaacacaatctaaaatgaattgtggtaagttttaggaattaaaaaataccagatagatcgggtaagcgagcatgggcagagggacagtgtatctgagcatccgagtactgtggggtaaaatcttgtataacttttctggtaactgaaaggaacaattaaaatgaattttagtaatcaagattaagtacttgcaaaaatagtacttagatatgtattgatatatatattcattgcatgctatgtgtttataaacttttgtttttattattttttgttagttttcaaaacacaggcaaactattacgaaaacaccaaattagagaaagaaaataataatagtataaaagtaaatgcatttagaggagtaagaaactcaaatataaaagcatttgcattagtgagtttttgacgagattttatcacaaattatattatattaatttataattattatttttgaaaatttgaaaaatttataccaaaatattttatttgaaagactttcacatgagtttcgcataaacatgtctttcattttttttaaaaaaactctttaattaagtaataataaacttcttccgtttcaatttaattgtcgttgtaaattaaaattttgttttaaaataagtatcgttttataatttcaatgtaaaaattatgaataatattttctagtttattttttattggttaaaatattgttaggtgtataattagtgatgtttttattttaaaaatggacaaaatattttattttttgtaatctatgtgtataaatctaaaactgtaactaaaataaatcggaggaagtaattagaagattcaccgatacaaataggcgtggtccgttgtcacatactattatgtatattttattttacaaaaatgttacttctataaatcgctaaaaagaatcaattaccggttaactgtgacactagcaaactgtttttactacagctagaaatcaaatctgacaagtggtcgttctggcctcaaatttcgaaaaacaaattattttgacaaagaaaaatagaaattattaaagagggaaatgttaccggaacccaagactcgtcgttttcaacatggccatggttctggtggtgtgtccgatggcttattctcctgcagcctcaaattattaaatatgtgtttacataaaaattaaattgtccatggaggtgattggttgggttttatctacctactttagctttatttttttctaaatcattaaactttaccaatcatgctttacgtttacttttcaaaattaaagtctacatcaaatttctattaatttttaccaatcatgctttaactttaaaaataaagctacagcaaaaaaaaaaccaaacatttttcttatgtattttagttaaacaacttacatctttcatttataagctgtagaaactgtaagaacaaaaaatatctataatattaaataaataagataatcataataaaaaaacatctataaatattttactctaattttgggtgcttttaaattattgaaatattttaaataatatagattatttacatatcacattttaaataacagtaaactttgataattttaaaaaatattaatataaattattttaagtgataaaaataataattattttatatatacatgcatcacatattttacatattttattttaaaatatctgcagcctatagcttacagctacaacaaatttaactacagcaaaagtctctgcaaaaataatcaacagtaacaactttacaactacaaccaatttatctacagctaaaattctacggccacagtcgaaccaatcatcacctatatagtgttgctttcatggcagattctaacaatctcactctattttttttctctttttttttgatcaaacaatctcactcttttaagttttaagttactagtaataaattgaccaaaaatagtttccagtaataaattatttttattgccaggaataagttacaataatgtcgcagcaaaataatgcatgtaagtctattttcaaagatatttgaagatgatgttacatttaccaaacaaaaaattatgatgttactacaggaaaccatttttattggaggtttgaagtcagtttctcaatattaaaaatagagaaatagaaaagaataaaagataaaaggagtaatttcccaataaacaaagtcatgaataattcttcaaatatctaacctttaataattggtttaatattatttataaaatgaatatttaattataaataaattagctgttgttcaaaaaaaattataaataaattatattcaaaatactaatgaccagatataggcccattgcatttaataaaagttttgattcctttttccttcgttgctaaagattcgatgcttttcgtcaagaataagaaaagctacctcacatatatagtcatactttcacatgcattatttaattataaaattggctctagccaaaaaaaaaaagaacgagcaatgaatagattcttgcaccaagtaattcatttaacatttaaaccaaaaaaagtataacaaatgaaagtttaataattaataataataataaaaagggttaataagttgacttaccaaccatggtaaggaacgaggatgaaggaatgaagaatatggccaaccacgctattcagcagaggaatgtctgagaaactcccatgtccactgccattattcaattatatttcacatcattattcatcgtaaatatagtatatcatttattgcactatttatttaaactttccatgtttgttttaaaagcttcaacaaggtaatgacgtgacacatttctaaatctcgaaatagattggaatacaccaaaataacaaagaaacaatattatctttcttgttttagaaaaacaatagatattcttgattttatactttaattataagttgagagatccataaaatgcggaagcagtcgtaattatagaaaataaagatgtggttttgtaacgagtcgtacgaccgatgaaaggtggtggaacaatgatttaaaaagaaaatctaaaaaaaaaaatcttagatcttcaaaaaatgaacatcaaaagaatcaattcataaagtactgacaatactcatagaacgtgcattcaataaatcgatgcaatgcaaaatggaagaaactttaccagtcgtggccgaggacgaagatggcccagaaaagggttccttgggcgacccaatagagaggccagaggaaccagctatcaaaatacacggcggcaatggccaaagcagcgacggcacaaatgtctctggctacgtagctcatagatctcaaaggacttttcacccaacaatgcttaggaatcgcagcccttatgtccccgatcttaaacggcggttgtgcgctcggatcaaacccttcttccttccgggcaccggcatcttcgttcacattggtgcgttggtccatagcaacaaccatcctgggagagagagagagagatttggaggaagattctctctctataattcaaaaaaaagaaagtgtgggaactggaatgtggtgaagaaagggttcgatgtattttgcggtctgtgaagtttgtttatataaaggggaaggaagatgtgtagtctgtagacattgagatgctcaaactgtttttattaaataattatatatttaaagaataaaaagggtaatttgctgtaattttaaatgcaatgggtttgttattttgttacatcgttctattcggtgaaattaaatgggaaattgaaggctataaccacaaaaaaaacgtaattcaccgtctagccatttaacctaacgatcttatacacgctgttacaaatataaaataatactgtaatattcctaaaacacaaccggctcaacctgctacaaaaaaataattaaatattttaattattcaccgttgaaaagtaactcgtgtcttacccttgttcacatcttccccttttaacttctctggtaattttgctgcagtcgaacggtctccggcaccgctttcttccatcgcctccactctgcatgcaatcgacatcttttccatctcttccgtcctctgttttcaatcttcttcggcgttacagttcttggttaaggtttcagcgacggtagtaagaaaccctttctacccaacttcaccacttcgattcttgtcaaatctctgaaccttccgtaagttctcattctatttcgtagattctcttcactgtgtcgtcctctgtgcttattttctttcaaattggggctcgtctcataatcagagtgttataatttctaggtctatatcaccggcagatgtgaatatcgatcgtccccgatacggaattagtctctcccactttccaatttgatttaggttttggtgtttcccgggttgtgtgaggttccttgaatttgaattttcttcgtagaggatatgcaacgtatttagtttagtactttatgtatttcgtgtggaatatcattgcttacaaagggtttgtcgataatacatagtatgttattttgattctccattccatttggaatgtaatagtacacttacccaattaagctattccattgtgtaacgcatcaattcattcctttgtttgtaatgtacttatggagttgctcattctaatttatggttcccctttatgttcttcttctttcttaatcgtgaattgatgtttctgtatcagtgctttttaaaaatagtgtatgaatatcgactaccgtgtggaatatcgtctcttgtacatagtctagaaattatgctttcttgtatggaatatcatctttatgtcatagttgtcttgtgttttatttgcaacattacatttggtttatctacatcatgtcacgttgaataaacactacaagaaaacacatgcttaacgacgaaaattaacgaggaaaaacaatcctcgtaaatttgcgtcgaatttacgacgaatttacgtgaaaaactaaagtcatccttatttcctcgtaacgtaacgacaaaactgtttcgtcgtaaagtggatgtaattttacgagtattttacgaggaaaaactatttcctcgtaaatacgacgtaaattttgcgtggtatttacgagggaatagtttacgtgtatttagcgaggaaatttttgaatccaccaacttcataggtgttacacgttttttttgcccacctaattaattttcgtcgtaaattcatagcaaaattacaactaccagattcgaattttcctataaatatggatgtttgaacatcattttaaacacaccaacaacaaaaaacgtgaaagaaaaaaaatggctggctccgggactatttacgagttgcggaagtggatgtatatgcatagagatgctaacgggagagtgacgaaagaataccttgcgggtctggagacatttatgcatcaagcagattcaacaccgctcgcccaagaaagtggtaagatgttctgtccttgtcggaaatgcaacaattcgaaactggcaaaccgtgaaaatgtttggaagcatttaataaatagaggtttcacggcaaattactatatctggtttcaacatggagaaggttttaattatgatcagaatgaagctagtagtagtaatagcaattctcaggaaaaagaaccggttgatcatcatttgcataatgaacatagttaccatcaggaggagatggtagattatgatagggttcatgatatggtagttgatgcattcgtagctcatgatgaagatgaagaacctaatataggtgcaaaaaagttttacgaaatgttaaacgcggcgaatcaaccactttacagtggttgtagagaaggtctctctaaattgtcgttagctgctagaatgatgaatattaaaactgatcacaatctacctgaaagttgcatgaacgaatgggcggacttgtttaaagagtatttgccggaagacaatgtgtctgctgattcttattatgagattcagaaactggtttatagttttgggttgccttcggagatgatagatgtttgcatcgacaactgcatgatctattggggagatgatgagaagctagaagaatgtcgattctgcaagaagccacgattcaagccgcaaggacggggacgtaatagggtaccgtaccaaaggatgtggtacctaccaattacagacagattgaaaagattgtatcaatcagagcagactgctggaaagatgagatggcatgccgaacatactcagacggatggtgagatggctcatccatcagatgcaagagcctggaaacatttcaacaaagtacatccagatttcgctagcaatatccggaatgtgtatctcggattatgcacagatggatttagtccgttcggaatgtcagggagacaatattcattgtggccagtctttcttactccatacaacctgccaccggagatgtgcatgcaacgggagttactattcttgaccatattaatacctggtccgaaccatccaaaaaggtccctggatgttttcctacaaccactgataaaagagttgaaggatttgtggtcaacaggggtgaggacgtatgactgttcaacgaagacgaattttacgatgcgagcgatgcttttgtggaccataagtgatttccctgcctatgggatgttgtctggatggactacacatgggagattagcttgtccatattgtaatggaacgacagatgcgtttcaactgaagaatggtaggaagacaagttggtttgactgtcaccgtcgatttcttcccattggccatccttaccgaagaaacaagaatttgtttaggcacaaaagggttgtgagagacactcctcctccatatctaactggagaacaaattgaagcgcaaatcgactactacggagctaacgaaacagttcgttggggtggtaattggcatgtccctcgtaatatgccagattcttacggtgttcatcacaactggcacaagaagagtatattttgggagttgccatattgaaaggatcttcttctgcgccacaacctcgatgtgatacatatagagaagaatttctttgagaacatcatgaatacaatattgaatgtcccagggaagacaaaagacaacataaaatcgaggttggacttgccagatatttgctcaagaagcgagttacatattaaaagcaatggacaagttcccgttccgatattcagattatcttcagaaaaaaagtcggtgttgttcaactgggtggcatcagaagtgaagttccccgatgggtatgtttcgaatctctctagatgtgttgaaaagggtcaaaagttctccgggatgaagagtcatgattgtcatgtatttatgcaacgactactgccctttgcatttgcggagctatttccaacaaacgtacatgaagcacttgcaggtacgtagtgtattatatcacaataatttacaaaataatatatgactaacaatgtgtttattttttttgaatataaaaggcattggagcatttttcagggatctgagcacacgcactcttaaagaagaagttgaggaacagcttcaggagaacattcccatcttattgtgcaacttggagaagatatttcctcccggattttttgacgtcatggagcatctagctgtccacctcccatatgaggcattgcttcgtggacctgtacattacggatggatgtatcagtatgagcgagccatgaaatatttgaagggaaaagcaaagaacctcgccaaagttgaaggttctataattgctggaagtttgacggaagaagtttctcacttcacatcgtactactttgcgtcaaaagtacgtacacggagaagagctccaagaagatatgatgatggtggtgttgcgccaacatatgcagttgctggtgttccagacatctttagccagattgggcgactcggtgggaagtctaaagaggtttggtggtcgagtgaacaagacgctcatagtgcacacacctatattctactcaattgcgaagatccattgatgcgttattttgaaaggtaacatatattgacacttcgaaacacatataagtataattaattgtataattgcgagagattcattcctataaaatgtgattttacagcctatttgtttctcaagtcgaagaaacatttcctggtatatccacaagtgacgtagacaaaaggaaagatcaacatttcattaagtggttgcggaatcaggtattaactaaaacttttttttcatacattatctgtatttcattaacattctctttatttttgcaggttgattatgacgacgacgatgcagattattctaagtggttacacgaagtaattcaatctccacttgtaaaggtcaccacatcacagatgtatttcacacgaggctatacttttcatacatatgactatggtagacagcgggcgaccagtaactatggagtatgtgtgaaagggaaaacagatttctacgggatcttgacggagattattgaagtcgaatttccagggatactgaagctgaaatgcgtcctcttcaaatgtgaatggttcgaccccgttgtcaacagaggtgttcggtctaacaaattcggtgtagttgatgtcaacggtggacgaaggtacaacaaattcgagcctttcatcttagcttcacaagcagaccaagttagcttccttccataccctcggatgagagattcaggtattaattggttagcagtaatcaaagttacacctcgaggacgaatcatcagtggagaagaaccaccattgcaagaagaacagataaatgaagttgaggaacctgaacaagaaattgatgacatccttctcattgatccgcataatcacgagtacgaagatcttaccgatgatgccacagacgaagctgttgaagacgagtttaatgaaaatgatgatgtttctagtgatgacgagaatgtcgatgtatccgattgatgtatttgttttatgaataagatgagagagtttgttttatgaataagataatgtggggtttgttttatgaataaggtaatgtgggagtttgttttatgaataagcaaatgtgggaattgtggtttggaatggaaataaagatggggtttggaatatatgaagtagaaaataaggaatataaggtttggggtttcgggttttggattctagggatttaaacataacagtcgttaattccacgtaagcttaaatcgtcgtaaagtcctcgtattccaactagtaaataacgacgaaggactcgttaattccacgtaagactaaatcgtcgtaaataccacgtaggatgaattcgtcgtaaaaaccacgtaggatgaatcgtcgtaaatataacgtaacataacgaggaaataacgacgaaacctaaaaataaatatggaatatgggatttggggtttggggtttcaggtttcgggtttcgggtttggggtttggggtttcgggttttggatttcgggtttcgggtttcgggtttttggtttcgggtttggggtttcggggtttggggtttcgggttttggatttcgagtttcgggtttcgggtttcgggtttcgggtttggggttctagggatttaaccataacactcgttaaaaataacgacgaaacttaaaattaaatatggggtttggaatatatgaagtagaaaattaaagatgggggtttgggtttcgggtttcgggtttcgggtttgggggttggggtttggggtttcgggtttgggtttcgggtttcggattctagggatttaaacataacactcgttaattccacgtaagcacaaatcgtcgtaactacctcgtaggatgaaatcgtcgtaactaccacgtaaaatgatttaaacaaaacactcgttaattccacgtaagcacaaatcgtcgtaaagtcctcgtaggatgaaatcgtcgtaactaccacgtaaaatgatttaaacaaaacactcgttaattccacgtaagcacaaatcgtcgtaaagaccacgtaaacggatttatacataaacccgttaattccacgtaagtacaaatcgtcgtaaatatctcgtagtgtacaaacttggaaaaaaaaggaaaaggagaaaaataccagattaacatgtggcaagacttccaacaattataatacgtaagtctcgcccacatgaattctaatatcttctccttttcctatttttttcaaatatttataatttgaataggatttttttgaggattgtgatttgagataaggtgtgatttgggagtttgtgtgtggtttgagagtgagagttgtgggtatatttataggaaagcaagcctcgttaattcctcgtaaagtaaatcgtcgttaatacctcgtataaaaaaacacgggcctttgtgattactcgcaatttcctcgtaaaaaaaaagacgggcctttgtaactgctcgctatttcgtcgtaaacttacgaggaatttgcggcgatatgtaatcttatatatacacccgagcgctcattctttctttcctctctacttcctctctacttcctctccatttcgtagcaatagtaagcctctctgattcctctctaatttggttagtttaggatagattaggtggttagtatagggaatttagataggtttgcggattttatgttatttagtgttgattaggtggataatgttgggaaatatattgttgatgttaattttaaaaatttcatttttttcccaggttcgaaaaggaagacttactgcccattacagagagatcttcggtgagccgggtagtcgtttagaccaggcctcttcttccgctcccagttcttcgggccaggagactgtccccgagactcagtacactcagagagtctctgggtctacttcttctagtgcaccatcggctcctcatgtgcctcctccgatgcctcctcctgtgcctcctccgatggcacctccgatggtcgccgatattcatcctgatctgatggtgcctccgagtgctccttactcgcagtacactgtagaggacattctccgtctgccaggcagagaaggtttaccagtcatcgacccagaccgaccggacggaacgttgtggtatgttgcattaattttttttaattcgtttaaatttcttttataacattaaaaataatttatattttaaatttgtattttccaggtggggggttgacggatgtcttgcatcggacgtaaccgacacaatcaagggttacttctccatggcacatccaaactggagtaagacgcctcactacgtcagaaagacgtggttcaaaatttacgctgtaagtttctattaattaattatatatattttaattttttcatgatttatatatatactttctaaaaaactaattgttaatttattttttccaacagcaaaaatataattgggccttgggaatcactgagagggtgaggaagaagtttaacgcgaaagcgaaagttcgcttgttggacacggtctccaactggaagggtgactggatcgtgaaggggtatgagtgtggcaaacccgctgagctcaccacggatgtgtgggatggcctcatccgttattggcgccttcctgattccattagaatcgcccaggcttactctaactcccgtaacacggtcgatgagcacgggaacgggccgatgcttcacactacgggccaaaaaccccacgccggtgtccgtttggaaatggtaattaaatattttattaaataatttttttaatatatatattaatttattctaactttcttaaatgttttttaggccaaagagacgggacatctcccgtctcttatggaactttacgagaggacctacaagaacaagacgggcgtatttgtagatggcaagtccgagcaaatctacaacgatgtagttgctcgggttgaagaccgccagactcagctgacccagcaatctaccgacggattacccgtcaccttatccacacttgaagtggataagatttacgaggaggtaaattttcaaaaaaattaattttttattattcatttaatttaactttaaatttttacttacaatatttatttttgtttttaaggttgtccccaaaaaaagggacggacgttgggtattggttccgtcaacgttgttccgagagcgacatcgtcttatggtcagcgacgggatgatgaagtcactgagctgcgtagagagtccgctcagctgcgtaacgagttgaccgcgacaaaatctcgtatgggtggagtcgagggcttcttggacgttattgcggccacaaatccggaatgggagtccatgttgaggaacatgcgacaacaacatcccattcaaggcgagtcatctgacgtacataacgaggcggatgttatgaggaggagtgatgaattctaccgggcgatgaacgaccctaagttttttttttggttgttgtattatataaattcaaaacttatttatatataaaatattttcatattgatttatttttattttgaattttaatttattattaaattaaataattttaattattttttaattatatttttaaattctgtaaaataataaaaacgaagtaaattcgtagccaatgtacgacctctttacgtggaaacctcacgaggaaatgacgagaaacatttaacgagtattttacgaagaatcatttacgagtaaataagaggaaaagtttacgaccattttacgaggaaatcatttcgtggttgttacgtgtattttgcgaggaaactctttcaaggtatttgtgtgtaggttacgaggaactattttcgaggtatttacgaggtattatggcgacgtccttacgtggaatattgacgtggtctttacgacgaatcgtcctacttcgtctttacgacgaaatatattcctcgctaagttacgacgaattagcgaggaaatatgtgttacgacagacgtgtaacgagcaaacgcgtttcctcgctaattcgtcgtaaagcctctcttacgacgaattagcgaggaaaaccgccctcgttaagattatgttttcttttagtgaaaatgaaaatataaggttgttgtattctactttacatggaattgtagctttatatctcatgaacatatcattcctcttcgttcttgttctgtcttaagtgataattcattgatatatttaatattttagcttccaccttcctcactatttccaactcttactttgaatcttcaggtttggtatgaacgagttaggccttccaagcagattgcttgagaccggctgtgaacccattggcaagaaaagggttaacaattattcaatctccggtggattgaagtgataaagagtgcattagaggatgaagacctagcgatgttgaatgcgtcacagtttgggtgagtcttgcagatggggacccataccttctcggttacgtttcttcactttattctatcccgccagctggtcactgtgaaggaattctagctgtggtggctctttgtggggaaacctattcgctatgttacaactgttctgcagtataaatggtaggtgggtttaagttcccgaatagttggattgccaatggagtagggtttatatttctctattttgggtttagttttttctttcacatgttatcttatcattcccattacatttgtatttcatattgctccatccttgctgaactatggcgacaatagccttgcaattatgaataagacaaatatgtacgtaacactataccacatatctagtaatggattgtgttttatgttttcttgcggggttcagtgtttaatttcaagtgttctcttatcttccccattacattaatattgtatgtaaaatactcctatatggaatatgaaaaatagaaaataacatagtttatattatatgaaatagaaaattgtacgtgatattgtccctacgtttcctattgccaacgaatttggggttgctttaccaatggattgaagtttatatttctctaacttgggtttagtgtttacttccaaatgatgtctactcattcctcttagctttgtattgtatgttgcccagttgtggatgtaatatacctagcatagcactttttaaaaggattgtgtctataggaaattaaatgtcttcagtactcatctttgtatgaattttccggtttgaaaacccatcgtttatgagggtcgatatcccacgccccaacaacaagtaatactctatcttcagtactcatatgcgataagaagtaaatgaagattcatttatatatcagtctctattccatgtaaaacttgtttttagtacatattctcactgcaaattagctggttgttacttccaggcagtaactccttaactttcttcacctccttgctttgagtttcttcagatggacttacagtgataagtagatggaatacaacatttattgctacaactactaatttacaccacttgtttaactccatacagtaaaaatatctttactaactccacctgtttacgtagcttcctcccactctttaatatggagtagctgtaagccattactggacatttactccattaattacgtcaccgtctgtccccaaccgtagaagtcattgtctttgtaagtgattatgttggtaaattacattcccaagtttatattctatttgttcatgtggcatggaacgtacactcatataaatttgatggtttgtatcataccgttgcattcaaatggttttggttgaccagacctaagcctgacgtcgacgttgttatattagaaataccccacgctatatgtacccacctcctcatccaactccatgtatcgtactttctaactcccacgcaactgtagctatgatattgttttataccatatggaatagtttggctgtacaataaatagtaactgttgattttgccgatctgaagctagcaacatgagtatttggcttcatttgggtaaagttttacgtactttccttgcgtcatgcacatttcaactgtaccaaaagtatttaccaaaatatttacatgctttttcaattggaactacatttatagggatactattacttttatactatgtagtatggatcttgtgtaactgctatagaatacacttgtttcatcgtcgacaattcgccatttgtttatggtacacttgcgattcttatctactcctacatctgcatctccttccataatgtgttgaatacatctcagttacgcgctccgtaagtttttgtgattgtaaacccaccacgtcgtttactttgtaatatagaaccggtaacctgttgctttaaggggcataaccgggtgggaggaatcacaaaagcctgacaatgaattatgtcaaaatcaacgctgcttttttaatttattcccagaaaatggctatttcgccaattaacccttaattgaattagaaaaatatgtatgcgaaagtaaatatataagacatattttatggaccggggatgtcctaggtcgaggactaatcataatgaactgtttagcatgtttttcaggcgacagataaatccgctgttctacgtggaaattagatatccacgccctttaacaacgtaaatgagtaaatctgaatgataggtttcaaaacgataatgcctaacactttcccgccgtatcacacgaccatatccatatggttgaaatatataaattcttctatttatattttgtctcagattatattacttctagaggcggatgaaaaaaatatgaaaatctgaacctgagaattcaaactattttgaatttgacataagcatccaaatggttattgttctatggtatttcagattttagtttttacccagatcaaaataatggaaatcgaaaaaaaaactcaaattttttaaaaacctttcaaaatacaaaatggatcaattttgaataattatccaaaatacttaaagatccaataattattcaaaatacttaatgaactataatatttaatttataaaattagtaatttatcaaaatatcatatttagatttatatattttttaaatatgtttatatgtaaaataaaaagaatagattttttgtgaattatatatataattaagttttataaacttagcttccatagtgtttattaaataatttgacatatatatatatatataatatgaatcacataatgttaatgtttttaaatataatctgataaataattataaatactttgaagtgttgaaaaagtttgaaatgaatttcattttaaataaaaaccatacataacaatattttgttatgtttatataatttttatacatcatttattaatttataattgtaatgagacaatataatttatgattttttataaatgttaatttactgaatattaatttgttgaaaatattaatttattgaatactaatttattaaatattaaaatatgattttattgaatattaaaaatattaatttatcgaatactaatttataaagcttctggtagtcgtctgttaactcatatatttctctaactactactgaataagcttgtgacttattatacacgtctatacgtgtttatctataaattgtttacgtcgaaagaatcatttcgtagatacccacgatgttacccaagttcaagaattaagaaaattaactatctatcattacgctacttaccaaaaataatatgaagagtaggcccgcgggaatatgctgcctgttataaatttgcaaatgacaataaaaataacttatatattacactgaaatatctctaatgtgtagggttataaagaaaaatataattagttaagctattcgttaacatttttgccccgttaattaactatgtattttgggttttgaactaatcataaaaatcatttaaaagacacaattgttgattcagacgaacaaaccaatacaagtgttgagggaatgtagttggtatagaacacgtcgtaagaatgatgtattttcgtgtaccatgggccggccctggcataaagcccataaaacaagtactttaggcaccaaatataataaaaaattcatgggcaccaaatttttttaaagtcaccttagtctaatgcattttacgttatcctcttgagcaacaagacacgagtttgacgcgtactttcttttcttccttttttgataataatgtcatttttgataatactaacaatttaatatgatttattcatggatacatatagacacggttagtttcttaatctgccgacaaaaaaattacttaatctaacaactattttctttaattatacatcttatattaaattgtgtgacactagataaataaatttaattaaacaaaaaactttttttggcaaataacaaacctatgtattagtaacaactaacaatcatttagattcttgacgtcttttgtgtatttcttgcgttgatctttgctataatagctgaagaagttataacaattaactcaaatgatcaattcttcatattccaagtttgttttaattgatatccatcggaatagctggcatatgtcatgtaagttttcattttttttctacttgttggtttctattgcttaaaaaaataaaattttaataaacaaaaaattattgtgagattttaacattcgatgctgacaaataatttttgaaaaaaaaaaaacttcagaaaataaggttttcattttttcttaaagtaaataaattttaatatgatttaatgctattttattaaataacaaaaataaagcaaaaattaatatattgaaagggcatatttgttaagtacgctttaggcaccagttaagtccggagcgacactgccacatatacaactcgctaaaacaaagatttattgtactgcatgaaccttccaaccacatatagactcatcaccacgacaaaaaaaaaaaaaacctggactacactcaagttgcgcaagccagtcatggaccgtagagtagcttggttcagaccgtgtagaggatcatatgtaaaggaagttcgaattcatagcaccagagaccatcgtttctagctaggtccatacaaactgagttttttcattgttttggaggagattcgcgcggaaccgaagttccgaaacccgatattgtcaatttgtcataagtgaattggcttctatacttctcgtaacaaaatcattaacatggattagtggtccaccaaaactgaaagataacatgttaaagaagtggactactacatagtcccagactcccaatcaacataagttacataaccaatagatgacaaatggtccatcaattatcaaatttgcttgcttttgttttgcaggtgttatttagtgtatccatcccgaaacgcattttctaaactcgtagtcttgtgcagttttctagtccaatcttcatattgttaccaagaaaaatacttgttatgtgaatattttttggattgcatgccactagccgaaatttcatggatcaatggatctttggcgtacatatatttattagaacactttcattacagaggatcctcaggaaaatatctcataataaaataaaaacaataaaaagagaataagataggatttttaaatgattatttttgaaaaaactcatgaaaactccatgaaatacttgtcttttccatataggttcaatttttattttaaattattcttaatcaattatttaaatttcatttaaatactgatattttgtttgagaatcaatgatgctctaagtggcaataattgtaaccagtactagtttctttattgaccaactgatatgaaacgagaattttctattttctatttttgttttagtatttatgtttctgttgccatgacaaagaaagagtgctaaaagatgagagatgttgcttgttaattgttatatacgagtagagtataaccatatcccgatttacatagataggattaggaagcgatacgttatacatatcaggatagaaatattagttgaaaatgagcactacgcgagatgttaaagaaaaaaaggcgtacattaaagcccttaatattcgacataagagcaccagcatcagcattagaggttcgtggacagtggcggagccagacgaaagttttaccaggggcaatgtaaaatttatcttcagtttatagggagcagtataagaaaattcaccattataatcatataattctcaaataaacaatggaaaaaaatattataatatgctacagtaatgatcctgtctcgccacgctccttccgtatgaacccgagttgtcactgttcagcgggctccacgccacgtggcggtctgctattggtcaatttatttatttattttttaaaaaaaaaacaaaataaaaataatagtaataaaataataaaaaattcaaattatgaaccccaaccgtgggttcattaatgctggtgctctaatatgtgtgccttaaataaaaacgtggctaatctatcaatacaaagcacagttaaaggtacaaccattaagaaaaagaagagttaaagatcacgatcacttcatgaatacacgtctcttcaacatcacaaaccattcatatgtatggtttaatatctaacagagtatatatttttcaaagagactattatggaagagtccatattaattttctaaggaggggtgcatccacagattgattttctttcatattttaaatgggttgtaaacaataattcatatccttatgattatataggtttagtgccgtggagtttattcgaacccggatctctctgaagtctacataccattagaccaatctcatgtggttaatcaagccaatttttgaagataactagatgtaaattaaacaattcaaagagttgttcagaaaaaaagagtgatggctttggacaagaaaaagaaagatgggatgttgtacgtgcacgtgtaaacgacgaaacacgttgggttctattcctaaagaagcattggctctactttctaacaaatctctaattatccaattaattatttgatcctaaacaatgacatctcgtttgaggttttctccttttttcgattcatcaatatttccctaggaaaaagttttgtttctgtcaacttgtaaatgatcaccgtgaatatcttacaacgacgcatattcccattacagaagaacaggtttcagtttggatcaacctaataagtttcagactttactaccttcactacaagaaaacacaaatttaacgacggccaaaatcgtcgttatttcctcggaaaagaaggcttacgaggaaatggcgatgaaaggcgtttcgtcgttatatgattgtcgtaagagaagattcgtcgccatttcctcgttaattagcgaggttatattttcctcgtaaagaagaattaagttttcgtcgtaaagaccacgtggggtttccacgtaacgcggtcgttgtgcttcctcgtaagaaactcgtaaatgattcgtcgtaaaagacccgcaaaaacctctaaataaattcgtcgtaataaaaacgtaagaaacacggaaacaattcgtcgtaatagaatcgtaactaaatccacgtaaaatcctcgttaattgttcctcgatatttcgtcgttaattttcctcgttaatacatcgggaattagcgacgcaattactttgttttctatttactgaatttataaataaaaattatatttatttaatttattaataaaattttaattgaaattaaatcgaatagaaaatatttttttggccgaattaaaatgaaattatataatatataaataagttttgaattttaaaatacaataa

SEQ ID NO: 15 - DNA, 3247 bp, Brassica napus
catcagaccctttcttcaccacatttcactcagagcccacacagttttagagagagagagaaacatccctcaaagctctctctctttctccggcgatggttgtcgctatggaccagcgtagcaatgcgaacggagacgaaaggtttgatccgagcgcacaaccaccgttcaagatcggagatataagggcggccattcctaagcattgttgggtaaagagtcctttgagatccatgagctatgtcgccagagacattttcgccgtcgtggctcttgccgtcgccgccgtgtattttgatagctggttcttttggcctctttattgggccgcccaaggaaccctgttctgggctatcttcgtactcggccacgactggtaatttaatttttctttcaacttcttaattttgatatgtttatatgtttttttcgttttttgcattgtctttgatttcttgaccgtacgttcgatatgagattttcactgacttcaagatttgattctcttcaggtttacttttttcaattttaattattatgttcatccaatttggcctattttaaaagcaaaaggggatctaagatttttaattcttttgtttttttttggttctttttcatcagtcgtaacactcctaactaaacatctttttctttcctataattattgttgtttccgcgttttatggatctacgtttgaaattttcaataaaacacattttattgttttctgtaacaatttaattactgtttattggttcttttaattattgtgtgttgttccaatctattttcgaaatatagtcatgtgacacgtcatattctatttttgttaccttgttgaaacgtttgaattgaggaaagttcagttaacattgtgcaataaatgataaatgtgtttatgatgtaaaatttcatttgaataatacagtggacatgggagcttctcagacattcctcttctgaatactgcggttggtcatattcttcattccttcattctcgttccataccatggttggtaagtcatttattttaacttcttttttcatgcaaatttattcttgttttcgtatttcttacattttccttgtcattcttggtgcatgttagcaaacagtaatctgataactgaaaatatattaatttttcatagtaaaataatgcatgtgactaaaagcatcaaaatctttagcatcgaagaaaaaagaaccaaacttttatttaatgctatgggcctatttatggtccaattagctattatcatatgacatgtccttgaataaattaatgtataagtttaatataatatttatatatatttgttttaatggcttattttattgttaaatggatacatcagcttgaaatatctacgaacatgcatcattttcctagatacatttgtttgttgctcaaaaaatgaataacgtagttaaacgagtgagattcttagcatctgcctcgaaaacgatatgttattgacaattccaatttcatttttatgaaaataaaataatagtttattttataattgggggtggttgcaggagaataagccatcggacacaccaccagaaccatggccatgttgaaaacgacgagtcttgggttccggtaatccccctctcattatttttttttctttttttgaaactctttcattttaattttcttagaattctatgtatttattttaatcaatcctttttccagtgtgaggcttggacgaccacttgtcagatttgtcgtttagctgtagtaaacaactgatttaaattgtttatggtactgtagttaactttaacaacgggccacttatattcgagccattggcataaaatgattcttctcgaaattcgtttacttttcttagtatttttcagttttgtagtttacgtagaactaataaaaagaaaaaaacttataaacacaccacatgcaatgaataaattcgaatatataaccatactgttaaatattaattaacattttaatcttaattttgcattccagttgccagaaaaattatacaagaatttgtcccacagtacacggatgctcagatacactgtccctctccccatgctcgcttaccctctctatctggtaaatcctaattcctcatttttcttcctgattataattacaattttgaatttttagattttgagtattaactaaatataaattaaatttgtttggggatgactacagtggtacagaagtcctggtaaagaagggtcacattataacccatacagtagtttatttgccccaagcgagagaaagcttattgcaacttcaactacttgctggtcgatcatgttggccactcttgtttatctatcattcctcgttggtccagtcacagttctaaaagtctatggtgttccttacattgtaagtttcatatatttcattattatatcattgctaatataatttgtttttgacataaagttttggaaaaatttcagatctttgtaatgtggttggacgctgtcacgtacttgcatcatcatggtcacgatgataagttgccttggtacagaggcaaggtaagtagatcaacattaatttataagaagcaacaatgattagtatttgattaatctaaattattgatgttttgtgtacaataataggaatggagttatttacgtggaggattaacaactattgatagagattacgggatcttcaacaacattcatcacgatattggaactcacgtgatccatcatcttttcccacaaatccctcactatcacttggttgatgccgtgagtgatctcgctctctctctagtttcatttgattaaaattaaagggtgattaattactaaattagtgatcttaattaatgatatgcgacagacgaaatcagctaaacatgtgttgggaagatactacagagaaccaaagacgtcaggagcaataccgatccacttggtggaaagtttggtggcaagtattaagaaagatcattacgtcagtgacactggtgatattgtcttctacgagacagatccagatctctacgtttatgcttctgacaaatccaaaatcaactaacctttcttcctagctctatttaggaataaaacagtcctttggtttttacttatttctggttgtttttaagttaaatgtactcgtgaaactttttttaattaaatgtatttacattacaaatcaagtttttgttcgttttctttatgtttttagttacaataaataaag

SEQ ID NO: 16 - DNA, 4014 bp, Brassica napus
catcgaaccctttcttcaccacattccacttcccacactctctttttttttgaattatagagagagaatcctcctccaaatctctctctctcccaggatggttgttgctatggaccaacgcaccaatgtgaacggagatgccggtgcccggaaggaagaagggtttgatccgagcgcacaaccgccgtttaagatcggggacataagggctgcgattcctaagcattgttgggtgaaaagtcctttgagatctatgagctacgtagccagagacatttgtgccgtcgcggctttggccattgccgccgtgtattttgatagctggttcctctgtcctctctattgggtcgcccaaggaacccttttctgggccatcttcgtcctcggccacgactggtaaagtttcttccattttgcattgcatcgatttattgaatgcacgttctacgagtattgtttgtcagttacttcgtaaaatgattcttttgatgttcattttttgaagatctaagattttttttttagattttctttttaaatcattgttccaccaccacctttcatcggtcgtacgactcgttacaacaccacatctttattttctataattactactgcttccgcattttatggatctctcaacttataattaaagtataatatcaagaatatctattatttttcttaaacaagaaagataatattgtttctttgttattttggtgtatttccaatctatttcgagatttagaaatgtgacacgtcattaccttgttgaagtgtttaaaacaaacatggaaagtttaaataaatagtgcaataaatgatatatatgtatatgatgaataatgatgtgaaatataattgaataatggcagtggacatgggagtttctcagacattcctctgctgaatagtgtggttggccatattcttcattccttcatcctcgttccttaccatggttggtaagtcagcttatcaaccctttttactatattattaattattaaacttgcatttgtatacttggtgcaagttggtaaatgtaatctgataactgaaaatctattcattgctcgttctattttttttttggctagagacaattttataattaaataatgcatgtgagaatatgactatttatgtgaggtagcttttcttattcctgtcgaaaagcatcaaatctttagcaacgaaggaaaaaggaatcaaattttttattaaatgcaatgggtctatgtcttggtcattagttttttgcatataatttatttatatttttttcttaacagcagctaatttaattataattaaatattcattttataaataatattagaccaattattaaaggttagatattttaagaattattcatgactttgtttattggaactccttttatcttttaatcttttctatttctccatttttaataatgagaaactgacttcaaatctccaataaagatggtcttatgtagtaacagtataattttttgtttggtaaatgtaacatcatcttcaaatatctttgaaaatagacttacatgcattattttgctgcgacattattgtcacttattcctggcaataaattagtttattactgaacttttttttggtcaatttattactagtaactttaaacttaaaagagtgagattgtttgatcaaaaaaaataaaaatagagtgagatagttagaatctgccatgaaagcaacactatatagacaatttaatttttatgaaaacacatttaataatttgaggctgcaggagaataagccatcggacacaccaccagaaccatggccatgttgaaaacgacgagtcttgggttccggtaacatttccctctttaataatttctatttttctgtcaaaataattagtttttcgaaatttgaggccagaacgaccacttgtcaaatttgatttttagctgtagtaaaaacagtttgctagtgtcacagttaaccggtaattgattctttttaacgatttatagaagtaacatttttgtaaaataaaatatacattatggtatgtgacaacggaccacgcttatttgtattggtgaatcttttaattactccctccaatttattttagttgcagatttagatttatgcacatagattaataaaaatattttgcacattttcaaaataaaaacaccattacttatacaactaaccatatttcaaccaataaaaataaattagaaaatattatttataaattttgtattgaaattataaaataatacttattttaaaacgaaattaatttacaacgacaattaaactgaaacggaaagaaattattaatacttaattaaagagtttttagaaaaattgaaagacatgtttatgcgaaactcatgtgaaagtctttgaaataatagattttggtataaatatttcaaattttcttaaaataataattatatattaatataatttgtgataaaatctcgtcaaaaactcactaatgcaaatgcttttattttgaatttcttactcctctaaatgcatttacttttatactaatattattttctttctctaatttggcgtttcgtaatagtttgtctgtattttgaaaactaacaaaaaataataaaaacaaaagcttataaacacatagcatgcaatgaatatgtacgaatatatataccaatacatatctaagtactatttttccaagtacttaatcttgattactaaaattcattttaattgttcctttcagttaccagaaaggttatacaagaatttaccccacagtactcggatgctcagatacactgtccctctgcccatgctcgcttacccgatctatctggtattttttaattcctaaaatttactacaagtcattttagactgtgttttaaaacaatataattatttttgtttggttttactgcagtggtacagaagtcctggaaaagaagggtcacattttaacccatacagtggtttatttgctccaagcgagagaaagcttattgcaacttcgactacttgctggtccataatgttggcaattcttatctgtctttccttcctcgttggtccagtcacagttctcaaagtatacggtgttccttacattgtaagtttcttagtatatcataaagggtatatatttattattcaatatatatactatatgatttgtttttgtcatatatttttgaaatattcagatctttgtgatgtggttggacgctgtcacttacttgcatcaccatggtcatgatgagaagttgccttggtacagaggcaaggtaattaaattaactattacaagtattttacaaaaaactaatgattagtatatttgattaatcttaattcttgatgttttgtgattaataataggaatggagttacttacgtggaggattaacaactattgatagagattacggaattttcaacaacattcatcacgacattggaactcacgtgatccatcatcttttcccacaaatccctcactatcacttggtcgatgctgtgagtcatctcactctctggctactttcatcaaaaccatttgattaaagggtgattaattactaatgtagtgattttaacaaatggaatgtgacagacaaaagcagctaaacatgtgttgggaagatactacagagaaccaaagacgtcaggagcaataccgatccacttggtggagagtttggtagcaagtattaagaaagatcattacgtcagtgacactggtgacattgtcttctacgagactgatccagatctctacgtttatgcttctgtcaaatcgaaaatcaattaaactttcttccccctttttgtttagcactattatgaataaaccagttttttttacttatatattgttgtttttaagttaaaaatgtactcgtgaaactcttcttaatttagatattattccatttacactgaaaaacatacaatttcaaaggttgaaaagaaagacaaaattttctagaatgac

SEQ ID NO: 17 - DNA, 4761 bp, Brassica napus
catcaaacctttcttcaccacatttcactgaaaggccacacatctagagagagaaacttcgtccaaatctctctctccagcaatggttgttgctatggaccagcgcagcaatgttaacggagattccggtgcccggaaggaagaagggtttgatccaagcgaacaaccaccgtttaagatcggagatatcagggcggcgattcctaagcattgttgggtgaagagtcctttgagatctatgagctacgtcgccagagacattttcgccgtcgcggctctggccatggccgccgtgtattttgatagctggttcctctggccactctactgggttgcccaaggaacccttttctgggccatcttcgttcttggccacgactggtaaattaaattttctgttttaattattttgactctttttgttcaatttattaatttcttgaatgcacgttcgatgagtatcgtcgtcactgacttcaagatttaattcttttgaggttaccttttcatgttcaattattaaaaaataaaataaaatataggatctaagatttttttcttcatcagttcaagcatcatcactcatcagtcgtaagactcgtaacaaaatatcttcttttctataattaatattatttccgcatttaatggatctacgttttgatgttctcaaattttgtttctctttctctagatccccggaacttttaattataattatagtatagtataatatcaagaaaatatactgtttattttttttggcaacaaatatattactcttgtttctttgacaagaaaaaaatatattgtttttttcttctttttgtgttccaatctattttcgagatttagacaagtgacacgtcatataccggatttgttaccttgttaaagagtttgggttaaaacaaatgtagaaaagttaaaataaattgtgcaataaatgataaatacgtttttatgttaaacaatgatgtgaaaataaaattgaataatggcagtggacatgggagtttttcagacattcctctgctgaacagtgtggttggtcacattcttcattcattcatcctcgttccttaccatggttggtaagtcatttattaactatttccatgtaaactattagtacttgttttcgtatttcttacattttcgtttgtcattcttcttgggtgcatgctagcaaactgtaatcagtattaactgggaactaccaactgttttttttttgctagagtagcaattttataattaaataagaatcctattaaacaatgcatgtgacaatatgaggttgcttttctgttcaaaacaaatctttagaagccaatgaaaaagaatccaaaacttttttttaaatgatatgcgcctatctattggtcctgactcctgagttttcttactttcttaagtataattagattttgatttttttttataggttttcactattgttatttgtttacatcagcttcagatatcttcgaaaaagatttacatgcatcaatttcatgaggatttatagtttttcttttacttatttccgacacaatgtttagtagtaaaaagcattaaatgtttttttgctcaaaaaaaaaagaatgggattgttagagcactctattgttagttgttcaataaatataccaactaaaaaaacaaaataaatataaaatgagtgagattgttaaatcattatagagacaatttcattttcacaaaaataaataaatacataactttttataattggggtttgcaggagaataagccatcggacacaccaccagaaccatggccatgttgaaaacgacgagtcttgggttccggtaatctttcctactctcgtagtttctcttgtcttttatttatttgtttgtttttcggaatttattcttatgtctatgttcttaggattctatatgtttattttattagtttatgttttcagtctgaggtcagaccgaccacttgtcagatctgttttctagctgtagtaaaaaacaatttgcaagtgtaatagttcagcataattgatcttgttagagcatttccaaaacaaactttataattttaaatatacagttttttgttctctaaaaaagaatttaaaaattttaaagtttgagggacgaaacttcaaatttgaactttcactactcaacttcaaatttgaaatttcatcttttttatttacattttgatcattataattaattatacattacatttatgattcttaagtattttctcatttattgttttaattcttaaattttttatacatcataaatatttccaatttgtttttataaattcaaattttacacaaaaaagtaataaaaattttaaataagatttataatattttaaaactataattaggcaaaaaaaatattacaaaaaaatgtaataaaaactttaaaataagatatatcaagacataattattagaaattttaaatattataacaatattaataatctggtaaatttgctccaaaacctcaaaaatttctaaattattgtccaaacaaatttgtttaaccgaatatggagcattacaaaaataattttatggaatagtgtggtattttgcttgtagttaatatttaattatgtatttctatttataattttatatatttaatgtaagatttttttaattaatattactgtaatatttttatatatgtactagttatttataaaagttttatagatttgtattagttataacaaaaataaggatcattgtgtaaaatacaaataattttgaaattacgtttaaagttttggttatgaaaaaaatactttgaaactttaaatttagagttttgcaaactttaaaatgttagatagatagtttttttggagatgcatttagtggttatggtagtaactcagaaaatgaaaaatctatacttttatactccctccgttttttaatataagtcgttttacagttatacacgtagattaagaaaaccattaatttcttatattttctagacaaaaacatcattaattatttacctaaccacaattcaaccaatataaaaatagaagatatattaccattggtcatacaacattaattattaataaattttacatagaaaaccgaaaacgacatataatttggaacaaaaaaatttctctaaaacgacttatattaaaaaacggagggagtagtacctaactttaacgatggaccacttatattcgagtccttagcataaaatgattctcctcgaaatccgtttactttcttcattattttttccttttcagttttggcgttttcgtaatacttttgtcttcaatcttgaaagctattagtataaaaacttataaacacatcacatgcaatgaattaatacgaatacataaccagaatgacaaattttcaatgaatatttaataccagtaagtactactccgtaatagtaatagtaatagtcatattaatttttttttgtcatcaaacaaacagtaatagtaatattaattataattatgtatttcagttgccagaaaagttgtacaagaacttgccccatagtactcggatgctcagatacactgttcctctgcccatgctcgcttacccgatctatctggtaaaaaaaaatacaatttcaatttttttcttaaaattacaaatggttttatattttgagttttaagccaatatataaattaattttgattggattttaactacagtggtacagaagtcctggaaaagaagggtcacattttaacccatacagtagtttatttgctccaagcgagaggaagcttattgcaacttcaacaacttgctggtccataatgttggccactcttgtttatctatcgttcctcgttggtccagtcacagttctcaaagtctatggtgttccttacattgtaagtttcacatattattacaagagatttatatattattaataataaatttgttttttgacataaagttttggaaaattttcagatctttgtaatgtggttggacgctgtcacgtacttgcatcatcatggtcacgatgagaagttgccttggtacagaggcaaggtaaataaatcaatttttaaaaagaaatgtacagaaagcaataatggttagtattgattaatcttaatttttgatgttttgcatacaataataggaatggagttatttacgtggaggattaacaactattgatagagattacggaatcttcaacaacatccatcacgacattggaactcacgtgatccatcatcttttcccacaaatccctcactatcacttggtcgatgcggtgagtgatctagctttctctctctctagtttcatttgattaaatggtgattaattactaatttaattaatgaattgtggacagacgagagcagctaaacatgtgttaggaagatactacagagagccgaagacgtcaggagcaataccgattcacttggtggagagtttggtcgcaagtattaaaaaagatcattacgtcagtgacactggtgatattgtcttctacgagacagatccagatctctacgtttatgcttcggacaaatctaaaatcaattaacttttcttcctagctctattaggaataaacactccttctcttttacttatttgtttctgctttaagtttaaaatgtactcgtgaaaccttttttattaatgtatttacgttacaaaaagtggaagttttgttatctttttctctagttgcaatcaaaagg

SEQ ID NO: 18 - DNA, 3827 bp, Brassica napus
catcaaactctctccaccacatttcactcagagcccacacagttttagagagagagaaacatccctcaaagctctctctttctccggcgatggttgtcgctatggaccagcgtagcaatgtgaacggagattccaaggacgaaaggtttgatccgagcgcacaaccaccgtttaagatcggagatataagggctgcgattcctaagcattgttgggtcaagagtcctttgagatccatgagctacgtcgcgagagacattttctccgtcgtggctctggccgtcgccgccgtgtattttgatagctggttcttctggcctctttattgggccgcccaaggaacccttttctgggccatcttcgtactcggccacgactggtaatttaattttcaatttattttttcttcaacttcttaattttgatatgtttatatgttttttcgttttttgcatcgtctttgatttcttgaacgcacgttcgatatgagattttcactgacttcaagatttgattctcttcaggtttacttttaaaaaaaaaaattattatgttcacccaaattggcctattttaaaagcaaaaggggatctaagatttttaattcttctctttttcagtcgtaacactgctaacttttttttttgatcaaatcgtaacactcataagtcctaactaaacatctttttctttcctataattattgttggttccgcattttatggatctacgtttgaaagtttcaataaaacacattttattgtttgaaagtaacaatataattactgtatattgattcttttaattattgtgtgttgttccaatctactttcgaaatatagtcatgtgacacgtcatattctatttttgttaccttgttggaacgtttgaattgagtaaagtttaattaacattgtgcaataaatgataaacatgtttatgatgtaaaattcaatttgaataatacagtggacatgggagcttctcagacattcctcttctgaatactgcggttggtcatattcttcattccttcattctcgttccataccatggttggtaagtcatttatttaaacatctttttcatgcaaatttattcttgttttcgtatttcttacattttccttgtcattcttggtgcatgttagcaaactgtaatctgataactgaaaatatattaattttccatagtaaaataatgcatgtgactaaaagcatcaaaatctttagcatcgaagaaaaaagaaccaaacttttatttaatgctatgggcctatttatggtccaattagctattatcatatgacatgtccttgaataaattaatgtagcttcatatgtgagtttaataatatttatatatttttgttttaatggcttattttattgttaaatggatacatcagcttgaaatgtctacgaacatgcatcattttcctagatacacttgtttgttgctcaaaaatgaataacttagttaaacgagtgagcatgttctatggggtttcttagagcatgattattgagaagttcctagagtgaggttcttaccggaatataagaatctatctcttaacttttaactaaaaaaattaagaaccggcttttaaaactcgtatttaagaaccgttttttagtttttttagttaaaaatcaagagacgagttcttatattccgctaagaactccaccctgagaacttctcaataatcatgctcttagtgctctaagaagggtccttaacaaaatattaataataagatatagtgtgggcccaaaaaaaacaaaaaaccggttacaaaagtcgcgaaagaaggatcgattttggtcttttacttgtactgtttgtggatcccactggtggtggtccgcgattggtttcttttttaatttaatttatttttttaatcggagaaaaaaattaagaaaccaaaaaacagttttaatcatggcctcatgttggggttgagttttatattctgataagaatcccatcttaaaaaccccgttaaacatgctcttaccatctgcttcgaaaatgatatgttattgacaattccaatttcatttttatgaaaataaaataatagtttattttataactgagggtggttgcaggagaataagccatcggacacaccaccagaaccatggccatgttgaaaacgacgagtcttgggttccggtaatctttccctctctcatattttttttcttttttttgaaattctttcattttaattttcttaggattctatgtatttattttaatcaatcctttttccagtttgaggctaggacgaccacttgtcagatttgtcgtttagctgtagtaaacaactgatttaaattgtttatagtactgtagttaactttaacaacggaccacttatattcgagccattggcataaaatgattcttctcgaaattcgtttacttttcttagtatttttcaattttggagtttacgtagaactaataaaaagaaaaacttataaacacaccacatgcaatgaataaattcgaatatataaccatactgttaaatattaatttacattttaatcttaattttgcattccagttgccagaaaaattatacaagaatttgtcccacagtacacggatgctcagatacactgtccctctccccatgctcgcttaccctctctatctggtaaatcctaattcctaatttttcttcctgattataattacaattttgaatttttagattttgagtattaactaaatataaattaaatttgtttggggatgactacagtggtacagaagtcctggtaaagaagggtcacattataacccatacagtagtttatttgccccaagcgagagaaagcttattgcaacttcaactacttgctggtcgatcgtgttggccactcttgtttatctatcattcctcgttggtccagtcacagttctaaaagtctatggtgttccttacattgtaagtttcatatatttctttattatatcattgctaatataatttgtttttgacataaaagttttggaaaaatttcagatctttgtaatgtggttggacgctgtcacgtacttgcatcatcatggtcacgatgataagctgccttggtacagaggcaaggtaagtagatcaacattatttataagaagcaataatgattagtagttgaataatctgaatttttgatgtttttgtacaataataggaatggagttatttacgtggaggattaacaactgttgatagagattacgggatcttcaacaacattcatcacgatattggaactcacgtgatccatcatcttttcccacaaatccctcactatcacttggtcgatgccgtgagtgatctcgctctctctctagtttcatttgattatattaaagggtgattaattactaaattagtgatcttaattaatgacatgcgacagacgaaagcagctaaacatgtgttgggaagatactacagagaaccaaagacgtcaggagcaataccgatccacttagtggaaagtttggtggcaagtattaagaaagatcattacgtcagtgacactggtgatattgtcttctacgagacagatccagatctctacgtttatgcttctgacaaatccaaaatcaattaatctttcttcctagctctatttaggaataaaacactcctttggttttacttatttctggttgtttttaagttaaaaatgtactcgtgaaacttttttttattaaatgtatttacattacaaatcgtaaaagtttttgttcgttttctctatgtttttagttacaaacttacaatcaaaaag

SEQ ID NO: 19 - DNA, 4668 bp, Brassica napus
catcaaacctttattcaccacatttcactgaaaggccacacatctagagagagaaacttcgtccaaatctctctctccagcgatggttgttgctatggaccagcgcagcaatgttaacggagattccggtgcccggaaggaagaagggtttgatccaagcgcacaaccaccgtttaagatcggagatataagggcggcgattcctaagcattgctgggtgaagagtcctttgagatctatgagctacgtcgccagagacattttcgccgtcgcggctctggccatggccgccgtgtattttgatagctggttcctctggccactctactgggttgcccaaggaacccttttctgggccatcttcgttcttggccacgactggtaaattaaattttcagttttaattattttgtctctttttgttcaatttattaatttcttgaatgcacgttcgatgagtatcgtcactgacttcaagatttaattcttttgaggttactttttcatgtttaattattaaaaaataaaagaaaatataggatctaagatttttttcttcatcaatgttcaagcatcgtcactcatcagtcgtcagactcgtaacaaaatatcttcttttctataattaatattatttccgcattttatggatctacgttttgatgttctcaatttttgtttctctttctctagatccccggaacttttaattataattatagtatagtataatatcaagaaaatatactgtttatttttttggcaacaaatatattgttttttgacaagaaaaatatattgtttttttcttctttttgtgttccaatctattttgtgatttagacaagtgacacgtcatataccggatttgttaccttgttaaagagtttgagttaaaacaaatgtagaaaagttaaaataaattgtgcactaaatgataaatacgtttttatgttaaataatgatgtgaaaataaaattgaataatggcagtggacatgggagtttctcagacattcctctgctgaacagtgtggttggtcacattcttcattcattcatcctcgttccttaccatggttggtaagtcatttattaactatttccatgtaaattattagtacttgttttcgtatttcttacattttcgtttgttattcttgggtgcaatgctaggaaactgtaatcagtattaactggaagctaccaacttttttttgttgctagagtagcaattttataattaaataagaatcctattaaacaatgcatgtgactatatgaggttgctttttctgttcaaaagcatcaaatctttagcagccaatgaaaaagaatccaaaccttttcttaaatgatatgcgcctatctatggtcctgagttttcttagttcattaagtataattagattttgatttttttttaggttttcacttattgttatttgtttacatcagcttcaaacatcttcgaaaaagacttacatgcatcaatttcctgaggatttatagttttttttacttatttctgcacaatgtttattagtaaaaagcatcaaatgtttttttgctcaaaaaaaagaatgggattgttagagcactctattgttagttgttcaataaatatatcaactaaaaaaacaaaataaatataaaatgagtgagattgttaaatcattatagagacaatttcattttcacaaaaataaataaatacataacttttgtaattggggtttgcaggagaataagccatcggacacaccaccagaaccatggccatgttgaaaacgacgagtcttgggttccggtaatctttcctactctcattgtttctcttgtcttttatttatttgttcttttttgggaattcattcttatgtctaagttcttatgattattgaagttcttaaggtggggttcttaacggaatatgagaacctgtctcttaacttttaactaaaaaagctaagaaccagcttttaaataagagttttatgaacacgttcttaatttttttagttaaaagttaagaaacgggttcttatattccgctaagaacctcttcctaaaaaccccaataatcatactcctaggattctatatgtttattttattagtttatgttttcagtctgaggtcagaccggccacttgtcagatctgttttctagctgtagtaaaaaacaatttgcaagtgtaatagttcagcggtaattaatgttctcggatctatctcaaaaaaaaattttataacttcaaatataaagatttttttgtttttcaaaaatgaacttcgaaacttcaaatttgaagttttttttttgcattttgatcattataattaattacacgttacatttataattcttaagtattttttcatttatcgttttaattcttaaattttttatatattataaatatttccaatttgtttttataaattcaaattttatacataaaagtaataaaaatgttaaataagatttataatatttaagactataattagtcaacaaaatattacaaaagaaatgtaataataaaaaatttaaaataagatacatgaagacataactattagaaaatttaaatattataacaatactaataatctggtaaatttgctctggaacctctaaaattattgtctaaacaaattttgtgtaaccgaagatggagcattacgaaaataattttatgaaataatatggtattttgcttctagtttaatatttaattatatatttctatttataattttatatatttaatgtaaatttttattaattaatattactgtaatatttttatatatgtgctagttatttataattttttttatggatttatattagaccatgattaacccggagttcttagagtggagttttagttaaacgttaagaaacagtttcttaacttccggtaagaaccccatcctaagaatcccaggttaatcatgctcttagttataacaaataaggatcattgtgtaaaatacaaataattttgaagttatgtttgaagtttgttttcgaagaaaaccactttgaaactttaaatttagagtaaactctatttagagagttttttttagaggttacgcagtaactcagaaaatgaaaaatctatacttttatagtacctaactttatcgatggaccacttatattcgagtccttagcataacatgattctcctcgaaatccgtttactttcttcgttattttttccttttcagttttggcgttttcgtaatacttttgtctgcaatcttgaaagctattagtataaaacttataaacacatgaattaatacgaatacataaccagaatgacaaattttcaatgaatatttaatactagtaagtactactccgtaatagtaattagtaatagtaatagtaatagtcatattaattataattatgtatttcagttgccagaaaagttgtacaagaacttgccccatagtactcggatgctcagatacactgtccctctgcccatgctcgcttacccgatctatctggtaaaaaaaatacaatttctattttttcttaaaattacaaatgattttatattttgagttttaagccaatatataaattaattttgattggattttaactacagtggtacagaagtcctggaaaagaagggtcacattttaacccatacagtagtttatttgctccaagcgagaggaagcttattgcaacttcaactacttgctggtccataatgttggccactcttgtttatctatcgttcctcgttgatccagtcacagttctcaaagtctatggcgttccttacattgtaagtttcacatattattacaagaaatttatatattattaataataaatttgttttttgacataagggtttggaaaattttcagatctttgtgatgtggttggacgctgtcacgtacttgcatcatcatggtcacgatgagaagttgccttggtacagaggcaaggtaattaaatcaatttttaaaaagaaatgtacagaaagcaataatggttagtattgattaatcttaatttttgatgttttgcatacaataataggaatggagttatttacgtggaggattaacaactattgatagagattacggaatcttcaacaacatccatcacgacattggaactcacgtgatccatcatcttttcccacaaatccctcactatcacttggtcgatgccgtgagtgatctagctttctctctctctagtttcatttgattaaatggtgattaattactaatttaattaatgaattgtggacagacgagagcagctaaacatgtgttaggaagatactacagagagccgaagacgtcaggagcaataccgattcacttggtggagagtttggtcgcaagtattaaaaaagatcattacgtcagtgacactggtgatattgtcttctacgagacagatccagatctctacgtttatgcttctgacaaatctaaaatcaattaacttttcttcctagctctattaggaataaacactccttctcttttacttatttgtttctgctttaagtttaaaatgtactcgtgaaaccttttttttattaatgtatttacgttacaaaaagtggaagttttgttatctttttctctggttgcaatcaaaagg

SEQ ID NO: 20 - DNA, 5714 bp, Brassica napus
catcgaaccctttcttcaccacattccagttcccacactttcttttttttgaattatagagagagaatcttcctccaaatctctctctctctctcccaggatggttgttgctatggaccaacgcaccaatgtgaacgaagatgccggtgcccggaaggaagaagggtttgatccgagcgcacaaccgccgtttaagatcggggacataagggctgcgattcctaagcattgttgggtgaaaagtcctttgagatctatgagctacgtagccagagacatttgtgccgtcgctgctttggccattgccgccgtgtattttgatagctggttcctctggcctctctattgggtcgcccaaggaacccttttctgggccatcttcgtcctcggccacgactggtaaagtttcttccattttgcattgcatcgatttattgaatgcacgttctatgagtattgtcagtactttatgaattgattcttttgatgttcattttttgaagatctaagatttttttttttagattttctttttaaatcattgttccaccacctttcatcggtcgtacgactcgttacaaaaccacatctttattttctataattacgactgcttccgcattttatggatctctcaacttataattaaagtataaaatcaagaatatctattgtttttctaaaacaagaaagataatattgtttctttgttattttggtgtattccaatctatttcgagatttagaaatgtgtcacgtcattaccttgttgaagcttttaaaacaaacatggaaagtttaaataaatagtgcaataaatgatatactatatttacgatgaataatgatgtgaaatataattgaataatggcagtggacatgtgagtttctcagacattcctctgctgaatagcgtggttggccatattcttcattccttcatcctcgttccttaccatggttggtaagtcaacttattaaccctttttattattattattaattattaaactttcatttgttatactttttttggtttaaatgttaaatgaattacttggtgcaagaatctattcattgctcgttctttttttttttggctagagccaattttataattaaataatgcatgtgaaagtatgactatatatgtgaggtagcttttcttattcttgacgaaaagcatcgaatctttagcaacgaaggaaaaaggaatcaaaacttttattaaatgcaatgggcctatatctggtcattagtattttgaatataatttatttataattttttttgaacaacagctaatttatttataattaaatattcattttataaataatattaaaccaattattaaaggttagatatttgaagaattattcatgactttgtttattgggaaattactccttttatcttttattcttttctatttctctatttttaatattgagaaactgacttcaaacctccaataaaaatggtttcctgtagtaacatcataattttttgtttggtaaatgtaacatcatcttcaaatatctttgaaaatagacttacatgcattattttgctgcgacattattgtaacttattcctggcaataaaaataatttattactggaaactatttttggtcaatttattactagtaacttaaaacttaaaagagtgagattgtttgatcaaaaaaaaagagaaaaaaaatagagtgagattgttagaatctgccatgaaagcaacactatataggtgatgattggttcgactgtggccgtagaattttagctgtagataaattggttgtagttgtaaagttgttactgttgattatttttgcagagacttttgctgtagttaaatttgttgtagctgtaagctataggctgcagatattttaaaataaaatatgtaaaatatgtgatgcatgtatatataaaataattattatttttatcacttaaaataatttatattaatattttttaaaattatcaaagtttactgttatttaaaatgtgatatgtaaataatctatattatttaaaatatttcaataatttaaaagcacccaaaattagagtaaaatatttatagatgtttttttattatgattatcttatttatttaatattatagatattttttgttcttacagtttctacagcttataaatgaaagatgtaagttgtttaactaaaatacataagaaaaatgtttggttttttttttgctgtagctttatttttaaagttaaagcatgattggtaaaaattaatagaaatttgatgtagactttaattttgaaaagtaaacgtaaagcatgattggtaaagtttaatgatttagaaaaaaataaagctaaagtaggtagataaaacccaaccaatcacctccatggacaatttaatttttatgtaaacacatatttaataatttgaggctgcaggagaataagccatcggacacaccaccagaaccatggccatgttgaaaacgacgagtcttgggttccggtaacatttccctctttaataatttctatttttctttgtcaaaataatttgtttttcgaaatttgaggccagaacgaccacttgtcagatttgatttctagctgtagtaaaaacagtttgctagtgtcacagttaaccggtaattgattctttttagcgatttatagaagtaacatttttgtaaaataaaatatacataatagtatgtgacaacggaccacgcctatttgtatcggtgaatcttctaattacttcctccgatttattttagttacagttttagatttatacacatagattacaaaaaataaaatattttgtccatttttaaaataaaaacatcactaattatacacctaacaatattttaaccaataaaaaataaactagaaaatattattcataatttttacattgaaattataaaacgatacttattttaaaacaaaattttaatttacaacgacaattaaattgaaacggaagaagtttattattacttaattaaagagtttttttaaaaaaaatgaaagacatgtttatgcgaaactcatgtgaaagtctttcaaataaaatattttggtataaatttttcaaattttcaaaaataataattataaattaatataatataatttgtgataaaatctcgtcaaaaactcactaatgcaaatgcttttatatttgagtttcttactcctctaaatgcatttacttttatactattattattttctttctctaatttggtgttttcgtaatagtttgcctgtgttttgaaaactaacaaaaaataataaaaacaaaagtttataaacacatagcatgcaatgaatatatatatcaatacatatctaagtactatttttgcaagtacttaatcttgattactaaaattcattttaattgttcctttcagttaccagaaaagttatacaagattttaccccacagtactcggatgctcagatacactgtccctctgcccatgctcgcttacccgatctatctggtattttttaattcctaaaacttaccacaattcattttagattgtgttttaaaacaatataaattattttttctttggttttactgcagtggtacagaagtcctggaaaagaagggtcacattttaacccatacagtggtttatttgctccaagcgagagaaagcttattgcaacttcaactacttgctggtccataatgttggccattcttatctgtctttccttcctcgttggtccagtcacagttctcaaagtatacggtgttccttacatcgtaagtttcttagtatatcataaagggtatatatttattattcaatatatatactatatgatttgtttttgtcataaacttttgaaattcagatctttgtgatgtggttggacgctgtcacttacttgcatcaccatggtcatgatgagaagttgccttggtacagaggcaaggtaattaaattaactcctaggtgattttcccgtgctcatgtacggatataaatatttctaaagtaaatatactataataattaattgttatttatttttaattttaaattagtttataatttgtatgcatgatttatattaataaaatttatattactttaattataaatatgattttatatatgttatatctaatcggttttgttgtttttacagtcgatttagttatcatttgggtaaattggattgcatctcagaattcaactgtaatattttttattttaactatattaaaattttgattaatttcttattttcatttaggtggttgttgtcttagaactttaaatatattttataaagattatgtataacttaatatatatattgtgcttaaaatgaaataaaaaataaaataaagtgtctgattctaaattacataaattaatataacgataatattctgaagtctcatgcatatatatatataaattttacaaaagaactaaattgtaacatttggttaatattttacagtaattaaaatattttataaattctaaataactttatgtatttaatttattgaatggaaactgaaatttattttaaataatcttaaaaatgaaaacatatttgctttggtattttgcttatggttccattaagttctacaaacataaaaacataacatttaaaaactgtgattattttgtaactatttgatcaaacaatgattattttttaattttaattttagttttttaataactcttaaaaataagcagtgaacaaaagtgagattgtatttgaaattaatattatacaagtaaaatataattttttaagtttataaaaaaattcctttttattatatgtatatgtttttttggaaaattttaaaaaggaaactaaataaaaaaataaataatagtattttaaatgtaatatttttaattcattaagtgtattagtgtaatcaactatcgtgagagttaacgtgagagcgatacatagaaaaccgacttctcaaataatattttatagagattacgatgtttcacaaaaaaaaattattagtatttgattaatcttaattcttgatgttttgtgattaataataggaatggagttacttacgtggaggattaacaactattgatagagattacggaattttcaacaacattcatcacgacattggaactcacgtgatccatcatcttttcccacaaatccctcactatcacttggtcgatgctgtgagtcatctcactctctcgctactttcatctaaaccatttcattaaagggtgattaattactaatgtactgattttaacaaatggaatgtgacagacaaaagcagctaaacatgcgttgggaagatactacagagaaccgaagacgtcaggagcaataccgatccacttggtggagagtttggtagcaagtattaagaaagatcattacgtcagtgacaccggtgacattgtcttctacgagactgatccagatctctacgtttatgcttctgtcaaatcgaaaatcaattaaactttcttccccctttttgtttagccctattatgaataaaccagtcttttttcacttatttattggtgtttttaagttaaaaatgtactcgtgaaactcttcttttattattaatccatttatacactgaaaaacatacaatttcaaaggttaaaaagaaaaataaattttctagactgac

SEQ ID NO: 21 - DNA, 20 bp, Artificial Sequence
  D_uni_F3_F1 Primer Sequence
gaataagccatcggacacac

SEQ ID NO: 22 - DNA, 20 bp, Artificial Sequence
  D_spec_F3_F2 Primer Sequence
atgcgaacggagacgaaagg

SEQ ID NO: 23 - DNA, 20 bp, Artificial Sequence
  D_spec_F3_F3 Primer Sequence
tgttaacggagattccggtg

SEQ ID NO: 24 - DNA, 20 bp, Artificial Sequence
  D_spec_F3_F4 Primer Sequence
gtagcaatgtgaacggagat

SEQ ID NO: 25 - DNA, 19 bp, Artificial Sequence
  D_uni_F3_R1 Primer Sequence
cagtgtatctgagcatccg

SEQ ID NO: 26 - DNA, 20 bp, Artificial Sequence
  D_spec_F3_R2 Primer Sequence
gtggccgagtacgaagatag

SEQ ID NO: 27 - DNA, 19 bp, Artificial Sequence
  D_spec_F3_R3 Primer Sequence
cagtagagtggccagagga

SEQ ID NO: 28 - DNA, 21 bp, Artificial Sequence
  D_UnivF2_F1 Primer Sequence
atgggtgcaggtggaagaatg

SEQ ID NO: 29 - DNA, 20 bp, Artificial Sequence
  D_UnivF2_F2 Primer Sequence
agcgtctccagatatacatc

SEQ ID NO: 30 - DNA, 20 bp, Artificial Sequence
  D_UnivF2_R1 Primer Sequence
atgtatatctggagacgctc

SEQ ID NO: 31 - DNA, 20 bp, Artificial Sequence
  D_UnivF2_R2 Primer Sequence
tagatacactccttcgcctc

SEQ ID NO: 32 - DNA, 20 bp, Artificial Sequence
  D_SpecificF2_F3 Primer Sequence
tctttctcctacctcatctg

SEQ ID NO: 33 - DNA, 20 bp, Artificial Sequence
  D_SpecificF2_R3 Primer Sequence
ttcgtagcttccatcgcgtg

SEQ ID NO: 34 - DNA, 19 bp, Artificial Sequence
  D_UnivF2_F4  Primer Sequence
gacgccaccattccaacac

SEQ ID NO: 35 - DNA, 20 bp, Artificial Sequence
  D_UnivF2_R4 Artificial Sequence
acttgccgtaccacttgatg

SEQ ID NO: 36 - DNA, 28 bp, Artificial Sequence
  27961 ZFP Target Site
cgccggagaaagagagagagctttgagg

SEQ ID NO: 37 - DNA, 28 bp, Artificial Sequence
  27962 ZFP Target Site
tggttgtcgctatggaccagcgtagcaa

SEQ ID NO: 38 - DNA, 28 bp, Artificial Sequence
  27969 ZFP Target Site
tctccgttcgcattgctacgctggtcca

SEQ ID NO: 39 - DNA, 28 bp, Artificial Sequence
  ZFP Target Site
gaaaggtttgatccgagcgcacaaccac

SEQ ID NO: 40 - DNA, 28 bp, Artificial Sequence
  27973 ZFP Target Site
tctccgttcgcattgctacgctggtcca

SEQ ID NO: 41 - DNA, 28 bp, Artificial Sequence
  27974 ZFP Target Site
tcggagatataagggcggccattcctaa

SEQ ID NO: 42 - DNA, 28 bp, Artificial Sequence
  27987 Target Site
tagcccagaacagggttccttgggcggc

SEQ ID NO: 43 - DNA, 28 bp, Artificial Sequence
  27988 ZFP Target Site
cttcgtactcggccacgactggtaattt

SEQ ID NO: 44 - DNA, 28 bp, Artificial Sequence
  27989 ZFP Target Site
ttgaagttgcaataagctttctctcgct

SEQ ID NO: 45 - DNA, 28 bp, Artificial Sequence
  27990 ZFP Target Site
acttgctggtcgatcatgttggccactc

SEQ ID NO: 46 - DNA, 28 bp, Artificial Sequence
  27991 ZFP Target Site
aagtagttgaagttgcaataagctttct

SEQ ID NO: 47 - DNA, 28 bp, Artificial Sequence
  27992 ZFP Target Site
tggtcgatcatgttggccactcttgttt

SEQ ID NO: 48 - DNA, 28 bp, Artificial Sequence
  28004 ZFP Target Site
aacgagaatgaaggaatgaagaatatga

SEQ ID NO: 49 - DNA, 28 bp, Artificial Sequence
  28005 ZFP Target Site
ataccatggttggtaagtcatttatttt

SEQ ID NO: 50 - DNA, 28 bp, Artificial Sequence
  28021 ZFP Target Site
ccaacgaggaatgatagataaacaagag

SEQ ID NO: 51 - DNA, 28 bp, Artificial Sequence
  28022 ZFP Target Site
cagtcacagttctaaaagtctatggtgt

SEQ ID NO: 52 - DNA, 28 bp, Artificial Sequence
  28023 ZFP Target Site
tgtgactggaccaacgaggaatgataga

SEQ ID NO: 53 - DNA, 28 bp, Artificial Sequence
  28024 ZFP Target Site
tctaaaagtctatggtgttccttacatt

SEQ ID NO: 54 - DNA, 28 bp, Artificial Sequence
  28025 ZFP Target Site
cgccggagaaagagagagctttgaggga

SEQ ID NO: 55 - DNA, 28 bp, Artificial Sequence
  28026 ZFP Target Site
tggttgtcgctatggaccagcgtagcaa

SEQ ID NO: 56 - DNA, 28 bp, Artificial Sequence
  28035 ZFP Target Site
cttaaacggtggttgtgcgctcggatca

SEQ ID NO: 57 - DNA, 28 bp, Artificial Sequence
  28036 ZFP Target Site
tcggagatataagggctgcgattcctaa

SEQ ID NO: 58 - DNA, 28 bp, Artificial Sequence
  28039 ZFP Target Site
tctccgatcttaaacggtggttgtgcgc

SEQ ID NO: 59 - DNA, 28 bp, Artificial Sequence
  28040 ZFP Target Site
ataagggctgcgattcctaagcattgtt

SEQ ID NO: 60 - DNA, 28 bp, Artificial Sequence
  28051 ZFP Target Site
agatggcccagaaaagggttccttgggc

SEQ ID NO: 61 - DNA, 28 bp, Artificial Sequence
  28052 ZFP Target Site
cgtactcggccacgactggtaatttaat

SEQ ID NO: 62 - DNA, 28 bp, Artificial Sequence
  28053 ZFP Target Site
ttgaagttgcaataagctttctctcgct

SEQ ID NO: 63 - DNA, 28 bp, Artificial Sequence
  28054 ZFP Target Site
acttgctggtcgatcgtgttggccactc

SEQ ID NO: 64 - DNA, 28 bp, Artificial Sequence
  28055 ZFP Target Site
aagtagttgaagttgcaataagctttct

SEQ ID NO: 65 - DNA, 28 bp, Artificial Sequence
  28056 ZFP Target Site
tggtcgatcgtgttggccactcttgttt

SEQ ID NO: 66 - DNA, 28 bp, Artificial Sequence
  24800 ZFP Target Site
cccaaagggttgttgaggtacttgccgt

SEQ ID NO: 67 - DNA, 28 bp, Artificial Sequence
  24801 ZFP Target Site
cgcaccgtgatgttaacggttcagttca

SEQ ID NO: 68 - DNA, 28 bp, Artificial Sequence
  24794 ZFP Target Site
taagggacgaggaggaaggagtggaaga

SEQ ID NO: 69 - DNA, 28 bp, Artificial Sequence
  24795 ZFP Target Site
ttctcctggaagtacagtcatcgacgcc

SEQ ID NO: 70 - DNA, 28 bp, Artificial Sequence
  24810 ZFP Target Site
gtcgctgaaggcgtggtggccgcactcg

SEQ ID NO: 71 - DNA, 28 bp, Artificial Sequence
  24811 ZFP Target Site
cagtggctggacgacaccgtcggcctca

SEQ ID NO: 72 - DNA, 28 bp, Artificial Sequence
  24814 ZFP Target Site
gagaagtaagggacgaggaggaaggagt

SEQ ID NO: 73 - DNA, 28 bp, Artificial Sequence
  24815 ZFP Target Site
gaagtacagtcatcgacgccaccattcc

SEQ ID NO: 74 - DNA, 28 bp, Artificial Sequence
  24818 ZFP Target Site
tcccaaagggttgttgaggtacttgccg

SEQ ID NO: 75 - DNA, 28 bp, Artificial Sequence
  24819 ZFP Target Site
accgtgatgttaacggttcagttcactc

SEQ ID NO: 76 - DNA, 28 bp, Artificial Sequence
  24796 ZFP Target Site
gagaagtaagggacgaggaggaaggagt

SEQ ID NO: 77 - DNA, 28 bp, Artificial Sequence
  24797 ZFP Target Site
tggaagtacagtcatcgacgccaccatt

SEQ ID NO: 78 - DNA, 28 bp, Artificial Sequence
  24836 ZFP Target Site
gtagagaccgtagcagacggcgaggatg

SEQ ID NO: 79 - DNA, 28 bp, Artificial Sequence
  24837 ZFP Target Site
gctacgctgctgtccaaggagttgcctc

SEQ ID NO: 80 - DNA, 28 bp, Artificial Sequence
  24844 ZFP Target Site
gaggccaggcgaagtaggagagagggtg

SEQ ID NO: 81 - DNA, 28 bp, Artificial Sequence
  24845 ZFP Target Site
actgggcctgccagggctgcgtcctaac

SEQ ID NO: 82 - DNA, 28 bp, Artificial Sequence
  24820 ZFP Target Site
gagaggccaggcgaagtaggagagaggg

SEQ ID NO: 83 - DNA, 28 bp, Artificial Sequence
  24821 ZFP Target Site
actgggcctgccagggctgcgtcctaac

SEQ ID NO: 84 - DNA, 28 bp, Artificial Sequence
  24828 ZFP Target Site
aggcccagtagagaggccaggcgaagta

SEQ ID NO: 85 - DNA, 28 bp, Artificial Sequence
  24829 ZFP Target Site
ccagggctgcgtcctaaccggcgtctgg

SEQ ID NO: 86 - DNA, 28 bp, Artificial Sequence
  24832 ZFP Target Site
tagtcgctgaaggcgtggtggccgcact

SEQ ID NO: 87 - DNA, 28 bp, Artificial Sequence
  24833 ZFP Target Site
agtggctggacgacaccgtcggcctcat

SEQ ID NO: 88 - DNA, 56 bp, Artificial Sequence
  FAD2_ZFN_Locus1_F PCR Primer
acactctttccctacacgacgctcttccgatctcgggccctctcycytacytcgcc

SEQ ID NO: 89 - DNA, 57 bp, Artificial Sequence
  FAD2_ZFN_Locus1_F2A  PCR Primer
acactctttccctacacgacgctcttccgatctacgtaccctctcycytacytcgcc

SEQ ID NO: 90 - DNA, 57 bp, Artificial Sequence
  FAD2_ZFN_Locus1_F2B   PCR Primer
acactctttccctacacgacgctcttccgatctcgtacccctctcycytacytcgcc

SEQ ID NO: 91 - DNA, 57 bp, Artificial Sequence
  FAD2_ZFN_Locus1_F2C   PCR Primer
acactctttccctacacgacgctcttccgatctgtacgccctctcycytacytcgcc

SEQ ID NO: 92 - DNA, 59 bp, Artificial Sequence
  FAD2_ZFN_Locus2_F1D   PCR Primer
acactctttccctacacgacgctcttccgatcttacgtgtcatagcccacgagtgcggc

SEQ ID NO: 93 - DNA, 59 bp, Artificial Sequence
  FAD2_ZFN_Locus2_F1E    PCR Primer
acactctttccctacacgacgctcttccgatctctgacgtcatagcccacgagtgcggc

SEQ ID NO: 94 - DNA, 59 bp, Artificial Sequence
  FAD2_ZFN_Locus3_F2F   PCR Primer
acactctttccctacacgacgctcttccgatcttgactgtcggcctcatcttccactcc

SEQ ID NO: 95 - DNA, 59 bp, Artificial Sequence
  FAD2_ZFN_Locus3_F2G   PCR Primer
acactctttccctacacgacgctcttccgatctgactggtcggcctcatcttccactcc

SEQ ID NO: 96 - DNA, 59 bp, Artificial Sequence
  FAD2_ZFN_Locus3_F2H   PCR  Primer
acactctttccctacacgacgctcttccgatctactgagtcggcctcatcttccactcc

SEQ ID NO: 97 - DNA, 58 bp, Artificial Sequence
  FAD2_ZFN_Locus4_F1J    PCR   Primer
acactctttccctacacgacgctcttccgatctgctagcagacatcaagtggtacggc

SEQ ID NO: 98 - DNA, 58 bp, Artificial Sequence
  FAD2_ZFN_Locus4_F1K  PCR Primer
acactctttccctacacgacgctcttccgatctctagccagacatcaagtggtacggc

SEQ ID NO: 99 - DNA, 59 bp, Artificial Sequence
  FAD2_ZFN_Locus5_F1L    PCR   Primer
acactctttccctacacgacgctcttccgatcttagctatctccgacgctggcatcctc

SEQ ID NO: 100 - DNA, 62 bp, Artificial Sequence
  FAD2_ZFN_Locus1_R1A    PCR   Primer
cggtctcggcattcctgctgaaccgctcttccgatctacgtactggtagtcgctgaaggcgt

SEQ ID NO: 101 - DNA, 62 bp, Artificial Sequence
  FAD2_ZFN_Locus1_R1B   PCR Primer
cggtctcggcattcctgctgaaccgctcttccgatctcgtacctggtagtcgctgaaggcgt

SEQ ID NO: 102 - DNA, 62 bp, Artificial Sequence
  FAD2_ZFN_Locus1_R1C   PCR Primer
cggtctcggcattcctgctgaaccgctcttccgatctgtacgctggtagtcgctgaaggcgt

SEQ ID NO: 103 - DNA, 63 bp, Artificial Sequence
  FAD2_ZFN_Locus2_R1D   PCR  Primer
cggtctcggcattcctgctgaaccgctcttccgatcttacgtggacgaggaggaaggagtgga

SEQ ID NO: 104 - DNA, 63 bp, Artificial Sequence
  FAD2_ZFN_Locus2_R1E   PCR Primer
cggtctcggcattcctgctgaaccgctcttccgatctctgacggacgaggaggaaggagtgga

SEQ ID NO: 105 - DNA, 63 bp, Artificial Sequence
  FAD2_ZFN_Locus3_R1F  PCR Primer
cggtctcggcattcctgctgaaccgctcttccgatcttgactagtgttggaatggtggcgtcg

SEQ ID NO: 106 - DNA, 63 bp, Artificial Sequence
  FAD2_ZFN_Locus3_R1G   PCR Primer
cggtctcggcattcctgctgaaccgctcttccgatctgactgagtgttggaatggtggcgtcg

SEQ ID NO: 107 - DNA, 63 bp, Artificial Sequence
  FAD2_ZFN_Locus3_R1H   PCR   Primer
cggtctcggcattcctgctgaaccgctcttccgatctactgaagtgttggaatggtggcgtcg

SEQ ID NO: 108 - DNA, 63 bp, Artificial Sequence
  FAD2_ZFN_Locus4_R1J    PCR Primer
cggtctcggcattcctgctgaaccgctcttccgatctgctagcccgagacgttgaaggctaag

SEQ ID NO: 109 - DNA, 63 bp, Artificial Sequence
  FAD2_ZFN_Locus4_R1K    PCR   Primer
cggtctcggcattcctgctgaaccgctcttccgatctctagccccgagacgttgaaggctaag

SEQ ID NO: 110 - DNA, 63 bp, Artificial Sequence
  FAD2_ZFN_Locus5_R1L    PCR  Primer
cggtctcggcattcctgctgaaccgctcttccgatcttagctgaaggatgcgtgtgctgcaag

SEQ ID NO: 111 - DNA, 58 bp, Artificial Sequence
  FAD3_ZFN_Locus1A_F3   PCR Primer
acactctttccctacacgacgctcttccgatctacgtacctttcttcaccacattyca

SEQ ID NO: 112 - DNA, 58 bp, Artificial Sequence
  FAD3_ZFN_Locus1B_F3    PCR Primer
acactctttccctacacgacgctcttccgatctcgtaccctttcttcaccacattyca

SEQ ID NO: 113 - DNA, 58 bp, Artificial Sequence
  FAD3_ZFN_Locus2C_F1   PCR Primer
acactctttccctacacgacgctcttccgatctctgacgatggttgtcgctatggacc

SEQ ID NO: 114 - DNA, 58 bp, Artificial Sequence
  FAD3_ZFN_Locus3D_F1   PCR  Primer
acactctttccctacacgacgctcttccgatcttgactcgaaaggtttgatccragcg

SEQ ID NO: 115 - DNA, 58 bp, Artificial Sequence
  FAD3_ZFN_Locus3E_F1   PCR  Primer
acactctttccctacacgacgctcttccgatctgactgcgaaaggtttgatccragcg

SEQ ID NO: 116 - DNA, 58 bp, Artificial Sequence
  FAD3_ZFN_Locus3F_F1    PCR   Primer
acactctttccctacacgacgctcttccgatctactgacgaaaggtttgatccragcg

SEQ ID NO: 117 - DNA, 61 bp, Artificial Sequence
  FAD3_ZFN_Locus4G_F1   PCR  Primer
acactctttccctacacgacgctcttccgatctgctagccgtgtattttgatagctggttc

SEQ ID NO: 118 - DNA, 61 bp, Artificial Sequence
  FAD3_ZFN_Locus4H_F1    PCR   Primer
acactctttccctacacgacgctcttccgatctctagcccgtgtattttgatagctggttc

SEQ ID NO: 119 - DNA, 60 bp, Artificial Sequence
  FAD3_ZFN_Locus5J_F1    PCR   Primer
acactctttccctacacgacgctcttccgatcttagctggagcttctcagacattcctct

SEQ ID NO: 120 - DNA, 60 bp, Artificial Sequence
  FAD3_ZFN_Locus6K_F1    PCR   Primer
acactctttccctacacgacgctcttccgatcttcagtgtttatttgccccaagcgagag

SEQ ID NO: 121 - DNA, 60 bp, Artificial Sequence
  FAD3_ZFN_Locus6L_F1    PCR   Primer
acactctttccctacacgacgctcttccgatctcagtcgtttatttgccccaagcgagag

SEQ ID NO: 122 - DNA, 60 bp, Artificial Sequence
  FAD3_ZFN_Locus6M_F1     PCR   Primer
acactctttccctacacgacgctcttccgatctagtcagtttatttgccccaagcgagag

SEQ ID NO: 123 - DNA, 60 bp, Artificial Sequence
  FAD3_ZFN_Locus6N_F1    PCR   Primer
acactctttccctacacgacgctcttccgatctgtcaggtttatttgccccaagcgagag

SEQ ID NO: 124 - DNA, 61 bp, Artificial Sequence
  FAD3_ZFN_Locus7P_F3    PCR   Primer
acactctttccctacacgacgctcttccgatctgtacgacttcaactacttgctggtcsat

SEQ ID NO: 125 - DNA, 61 bp, Artificial Sequence
  FAD3_ZFN_Locus7Q_F3     PCR   Primer
acactctttccctacacgacgctcttccgatcttacgtacttcaactacttgctggtcsat

SEQ ID NO: 126 - DNA, 62 bp, Artificial Sequence
  FAD3_ZFN_Locus1A_R1    PCR   Primer
cggtctcggcattcctgctgaaccgctcttccgatctacgtacgttcacattgstrcgytgg

SEQ ID NO: 127 - DNA, 62 bp, Artificial Sequence
  FAD3_ZFN_Locus1B_R1    PCR    Primer
cggtctcggcattcctgctgaaccgctcttccgatctcgtaccgttcacattgstrcgytgg

SEQ ID NO: 128 - DNA, 63 bp, Artificial Sequence
  FAD3_ZFN_Locus2C_R1     PCR   Primer
cggtctcggcattcctgctgaaccgctcttccgatctctgacccgatcttaaacggyggttgt

SEQ ID NO: 129 - DNA, 65 bp, Artificial Sequence
  FAD3_ZFN_Locus3D_R1    PCR   Primer
cggtctcggcattcctgctgaaccgctcttccgatcttgacttagctcatggatctcaaaggact

SEQ ID NO: 130 - DNA, 65 bp, Artificial Sequence
  FAD3_ZFN_Locus3E_R1   PCR   Primer
cggtctcggcattcctgctgaaccgctcttccgatctgactgtagctcatggatctcaaaggact

SEQ ID NO: 131 - DNA, 65 bp, Artificial Sequence
  FAD3_ZFN_Locus3F_R1    PCR    Primer
cggtctcggcattcctgctgaaccgctcttccgatctactgatagctcatggatctcaaaggact

SEQ ID NO: 132 - DNA, 62 bp, Artificial Sequence
  FAD3_ZFN_Locus4G_R_uni    PCR   Primer
cggtctcggcattcctgctgaaccgctcttccgatctgctagttaaattaccagtcgtggcc

SEQ ID NO: 133 - DNA, 62 bp, Artificial Sequence
  FAD3_ZFN_Locus4H_R_uni   PCR   Primer
cggtctcggcattcctgctgaaccgctcttccgatctctagcttaaattaccagtcgtggcc

SEQ ID NO: 134 - DNA, 66 bp, Artificial Sequence
  FAD3_ZFN_Locus5J_R2    PCR   Primer
cggtctcggcattcctgctgaaccgctcttccgatcttagctcttttttcttcgatkctaaagatt

SEQ ID NO: 135 - DNA, 62 bp, Artificial Sequence
  FAD3_ZFN_Locus6K_R1    PCR   Primer
cggtctcggcattcctgctgaaccgctcttccgatcttcagtctgtgactggaccaacgagg

SEQ ID NO: 136 - DNA, 62 bp, Artificial Sequence
  FAD3_ZFN_Locus6L_R1    PCR   Primer
cggtctcggcattcctgctgaaccgctcttccgatctcagtcctgtgactggaccaacgagg

SEQ ID NO: 137 - DNA, 62 bp, Artificial Sequence
  FAD3_ZFN_Locus6M_R1    PCR   Primer
cggtctcggcattcctgctgaaccgctcttccgatctagtcactgtgactggaccaacgagg

SEQ ID NO: 138 - DNA, 62 bp, Artificial Sequence
  FAD3_ZFN_Locus6N_R1    PCR   Primer
cggtctcggcattcctgctgaaccgctcttccgatctgtcagctgtgactggaccaacgagg

SEQ ID NO: 139 - DNA, 66 bp, Artificial Sequence
  FAD3_ZFN_Locus7P_R1   PCR  Primer
cggtctcggcattcctgctgaaccgctcttccgatctgtacgacttacaatgtaaggaacrccrta

SEQ ID NO: 140 - DNA, 66 bp, Artificial Sequence
  FAD3_ZFN_Locus7Q_R1   PCR Primer
cggtctcggcattcctgctgaaccgctcttccgatcttacgtacttacaatgtaaggaacrccrta

SEQ ID NO: 141 - DNA, 13472 bp, Artificial Sequence
  T-stand Insert Region of pDAS000130
gaaatatccttcctattcaaagttatatatatttgtttacttttgttttagatctggacctgagacatgtaagtacatatttgttgaatctttgggtaaaaacttatgtctctgggtaaaatttgctgagagatttgaccgattcctattggctctggattctgtagttacctaatacatgaaaaagtttcatttggcctatgctcacttcatgcttataaactttttcttgcaaattaattggattagatgctccttcatagattcagatgcaatagatttgcatgaagaaaataataggattcatgatagtaaaaagattgtatttttgtttgtttgtttatgtttaaaagtctatatgttgacaatagagttgctatcaactgtttcatttaggtttatgtttttgtcaagttgcttattctaagagacattgtgattatgacttgtcttctctaacgtagtttagtaataaaagacgaaagaaattgatatccacaagaaagagatgtaagctgtaacgtatcaaatctcattaataactagtagtattctcaacgctatcgtttatttctttctttggtttgccactatatgccgcttctctgctctttatcccacgtactatccattttttttgtggtagtccatttttttgaaactttaataacgtaacactgaatattaatttgttggtttaattaactttgagtctttgcttttggtttatgcagaaacatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggccggtaccgccttttgcagtttatctctatgcccgggacaagtggagtccatgctcaacaccgtgcaggatgaggatgaccaccgcggtagcgacttcgtgggcgaggaaagcctttcgtccaaggtggtccctcctcgcaatcttgttggatggtgaatattataaaagcctgcccttctcgcgggtgtttaaacgtcgacctgcaggtcaacggatcaggatattcttgtttaagatgttgaactctatggaggtttgtatgaactgatgatctaggaccggataagttcccttcttcatagcgaacttattcaaagaatgttttgtgtatcattcttgttacattgttattaatgaaaaaatattattggtcattggactgaacacgagtgttaaatatggaccaggccccaaataagatccattgatatatgaattaaataacaagaataaatcgagtcaccaaaccacttgccttttttaacgagacttgttcaccaacttgatacaaaagtcattatcctatgcaaatcaataatcatacaaaaatatccaataacactaaaaaattaaaagaaatggataatttcacaatatgttatacgataaagaagttacttttccaagaaattcactgattttataagcccacttgcattagataaatggcaaaaaaaaacaaaaaggaaaagaaataaagcacgaagaattctagaaaatacgaaatacgcttcaatgcagtgggacccacggttcaattattgccaattttcagctccaccgtatatttaaaaaataaaacgataatgctaaaaaaatataaatcgtaacgatcgttaaatctcaacggctggatcttatgacgaccgttagaaattgtggttgtcgacgagtcagtaataaacggcgtcaaagtggttgcagccggcacacacgagtcgtgtttatcaactcaaagcacaaatacttttcctcaacctaaaaataaggcaattagccaaaaacaactttgcgtgtaaacaacgctcaatacacgtgtcattttattattagctattgcttcaccgccttagctttctcgtgacctagtcgtcctcgtcttttcttcttcttcttctataaaacaatacccaaagagctcttcttcttcacaattcagatttcaatttctcaaaatcttaaaaactttctctcaattctctctaccgtgatcaaggtaaatttctgtgttccttattctctcaaaatcttcgattttgttttcgttcgatcccaatttcgtatatgttctttggtttagattctgttaatcttagatcgaagacgattttctgggtttgatcgttagatatcatcttaattctcgattagggtttcatagatatcatccgatttgttcaaataatttgagttttgtcgaataattactcttcgatttgtgatttctatctagatctggtgttagtttctagtttgtgcgatcgaatttgtcgattaatctgagtttttctgattaacagatggcttcatctgagaacgttatcactgagttcatgaggttcaaggtgaggatggaaggtactgttaacggacatgagttcgagatcgagggtgagggtgaaggtagaccttacgagggacataacaccgttaagcttaaggttacaaagggtggacctcttcctttcgcttgggatatcctttctcctcaattccaatacggaagcaaggtaagtttgtggattcttcgtccatgtgatctttgagtttctttagagcttgtgagggattagtaagtaacaatgcttgagttttttgctgctgggcttcgaaaagtttgtcacttgttggtttgatccacaaggtcttcttctccatagctactagacatgttttagcttaagattcaagtttatatatgccttgtggattaatcattgcctgattcttccgtgtcatctctgagtttatttagagcttggaagtggtgtagtaataactaacaatactcttgataagttgtagcaatgctcttgattagtggatgtaatatgatgttgataagatatatgaggcacagaaccaaaagtggtgcttccactagacccgtttttagcctaaggttcaagtttataccttgtagatgtttctgtattgtctgattcttccctgtgatatttgaatttcttagagctttggaagtgatataggaacaatgctcttgtgtgtttgtctctatgaagattatcgctgtcgtgtttcatccgagtgtgcgggattttttgctgctgggtttagcctttcttcaaaaagttattacttgttagttttattgttttggtcttgataagagatgttaggacagacatggtgcttcttgtctatagccactagacctattttagcataaggttaacgaaattctctctacataccttgtggatttgtttacattgcctgatctttcctgtgatcgctgtcatgtttctttggaatgattgatgtttataaatggaaaaatctttgtgcagaagactcccgcccatctctctatgcccgggacaagtgccaccccacagtggggcaggatgaggatgaccaccatggggtcgcagcgtgtgcgtgtccgtcgtacgttctggccggccgggccttgggcgcgcgatcagaagcgttgcgttggcgtgtgtgtgcttctggtttgctttaattttaccaagtttgtttcaaggtggatcgcgtggtcaaggcccgtgtgctttaaagacccaccggcactggcagtgagtgttgctgcttgtgtaggctttggtacgtatgggctttatttgcttctggatgttgtgtactacttgggtttgttgaattattatgagcagttgcgtattgtaattcagctgggctacctggacattgttatgtattaataaatgctttgctttcttctaaagatctttaagtgctgtttaaacaaccgacaaccactttgcggacttcctttcaagagaattcaataaggttaattcctaattgaaatccgaagataagattcccacacacttgtggctgatatcaaaaggctactgcctatttaaacacatctctggagactgagaaaatcagacctccaagcatgaagaagcctgagcttactgctacttctgttgagaagttcctcatcgagaagttcgattctgtgtctgatcttatgcagctctctgagggtgaggaatcaagagctttctctttcgatgttggtggaagaggatacgttctcagagttaactcttgcgctgacggattctacaaggatagatacgtgtacagacacttcgcttcagctgctctccctatccctgaagttcttgatatcggagagttctctgagtctcttacctactgtatctcaagaagggctcagggtgttactcttcaagatcttcctgagactgagcttcctgctgttcttcaacctgttgctgaggctatggatgctatcgctgctgctgatctttctcaaacttctggattcggacctttcggtcctcagggaatcggacagtacactacttggagagatttcatctgcgctatcgctgatcctcatgtttaccattggcagaccgttatggatgataccgtttctgcttctgttgctcaagctcttgatgagcttatgctttgggctgaggattgtcctgaggttagacatcttgttcacgctgatttcggatctaacaacgttctcaccgataacggaagaatcaccgctgttatcgattggtctgaggctatgttcggagattctcaatacgaggtggccaacatattcttttggaggccttggcttgcttgtatggaacaacagactagatacttcgagagaaggcatcctgagcttgctggatctcctagacttagagcttacatgcttaggatcggacttgatcagctttaccagtctctcgttgatggaaacttcgatgatgctgcttgggctcagggaagatgtgatgctatcgttagatctggtgctggaactgttggaagaactcaaatcgctagaagatctgctgctgtttggactgatggatgtgttgaagttctcgctgattctggaaacagaaggccttctactagacctagagccaagaagtgaagatcggcggcaatagcttcttagcgccatcccgggttgatcctatctgtgttgaaatagttgcggtgggcaaggctctctttcagaaagacaggcggccaaaggaacccaaggtgaggtgggctatggctctcagttccttgtggaagcgcttggtctaaggtgcagaggtgttagcgggatgaagcaaaagtgtccgattgtaacaagatatgttgatcctacgtaaggatattaaagtatgtattcatcactaatataatcagtgtattccaatatgtactacgatttccaatgtctttattgtcgccgtatgtaatcggcgtcacaaaataatccccggtgactttcttttaatccaggatgaaataatatgttattataatttttgcgatttggtccgttataggaattgaagtgtgcttgcggtcgccaccactcccatttcataattttacatgtatttgaaaaataaaaatttatggtattcaatttaaacacgtatacttgtaaagaatgatatcttgaaagaaatatagtttaaatatttattgataaaataacaagtcaggtattatagtccaagcaaaaacataaatttattgatgcaagtttaaattcagaaatatttcaataactgattatatcagctggtacattgccgtagatgaaagactgagtgcgatattatggtgtaatacatagtttaaacgggcccaagactcccgcccatctctctatgcccgggacaagtgccaccccacagtggggcaggatgaggatgaccagtcagttttacttcccttaattttctatgtactttcataattacttatgttattttcttcatgagttttaatgcaaattactatatggactctagtgaaaacgttcagaatcctataaacatgactactgagacgaacttgagagtagttttgatcatacacacgtttcatgtggtacttgagagttactaatttttgtcatcttcgtataagtagtaaaagatactacaagaatagtttagtagaaaatactagcggtaggtgaagatttgtcgctatgtactattattgtctagtaacttgagtaacaatttcgtggtctaaatatcaaataaaaatggatgagtggttcaccaaatctaggcatcaaaactattaatgtcattgtctagatcttaggtgacaccacatttcgaatatttattggtaattgagatgttaaagtaccaatatttgacttaataaactaaaagattttggctttatcaaatgtagacattgatgacatatcgttgtcattatcttgagtatatacaagtcgatcaattaggtgaaagtttagtgtctcgtggttggtaaacgattaatacagtagtatattttatccaaagacaaaatccaaatcatttcaccagtatgaatagtattattttatcttaaaagctaaaatcttaaaaaccaaggtagcacccacgttgagctagacgatcaaatcgatttctgctttgtccaatttaccaagctatttaaagccaaataattgaaatataggtaggtcgttatattaggctaagatttatctcaaatgcttaactaaaggaataacaagggattctagttgtgtggttttataagattggtccaatttcacttaagtttgtttattgtagaattttatatgtgaataatttgaattccaattgaaaagatattatagtaaaagaaaaaatagtgcgaacaaaaaactttaatcccataaaaagaaaaagaaaaatgaaaagttcttctaacatccatattttgcatcatatcataaagataagaaagatacatatcatagacgtacagataaacaaacatatcatcatttgtgaaatacatagtacaataatttgcttttaaatagagtttaagtcacacacactgacacacacgataaaacgataatgtctgcaaaaacactttaatcccattgcctagaggacagcttctccactttgtctttaaggttggttttgccgtgttgtttttatctttatataatgatctattttttggattatgaaatgaattcacacattttaattatttaagaagatccatatacaggtttataacagtactaagtgatgattattttttgtttttgcatagtttagtttattgggtaaacattcattacgtgtctctttatacgaatcacccatccaaaatttcaagtagtcttttagttcatttattatttcataactatttgacttattgatttgacaagaaacaacaaaagtgttgacttattgatagattgtgggatcataaaagtaattaagcgtcaaccacgacccacaacaacaaagcacatgttatacattaatatctcgtttacttaattacagttttcagaatgccgtttcatgtcttgtcactggcgatgttattatcatgttggacaatattcgactgttgtcgtttttacattttcgtattgactaaaactaaaaaaacaaaactctgtttcaggttgggcctaggatccacattgtacacacatttgcttaagtctatggaggcgcaaggttttaagtctgtggttgctgttataggccttccaaacgatccatctgttaggttgcatgaggctttgggatacacagcccggggtacattgcgcgcagctggatacaagcatggtggatggcatgatgttggtttttggcaaagggattttgagttgccagctcctccaaggccagttaggccagttacccagatctaatatcaaaatctatttagaaatacacaatattttgttgcaggcttgctggagaatcgatctgctatcataaaaattacaaaaaaattttatttgcctcaattattttaggattggtattaaggacgcttaaattatttgtcgggtcactacgcatcattgtgattgagaagatcagcgatacgaaatattcgtagtactatcgataatttatttgaaaattcataagaaaagcaaacgttacatgaattgatgaaacaatacaaagacagataaagccacgcacatttaggatattggccgagattactgaatattgagtaagatcacggaatttctgacaggagcatgtcttcaattcagcccaaatggcagttgaaatactcaaaccgccccatatgcaggagcggatcattcattgtttgtttggttgcctttgccaacatgggagtccaaggttgtttaaacatttaaataccctgccaagcttgaggtagcctccaatttgacggtgccgccagcgacgccgtctggaactgtcctttttgaggaccactccgtttgtggagatcatgagagtccatgctcaacaccgtgcactagggacaggattgaagactcccgcccatctcactagggacaggattgccaccccacagtggggcctagaaagactggagttgcagagtttgtgtcttctagattaatcctccaaacttttgattaaccaaaaaaattatcaaactaacatgttctccttttttctttagaaattctaacgaatttatctttatactgatttgaatatacttaatttggtcatttggatgccctttacaacctccttaccaaactattgatcacagtttctattgctaaaatcaccaacaaaacgcatgtcgccattcataattatggtttcacacctacaactaggctaataagtaaataagtagacaactagactcaggtttgaaaaaaccataaaagccatatagcgttttctcattgaaactgcgaacacgatcgtgtgaatgttgcagtttctagttttgatacaaacaaacaaaaacacaatttaatcttagattaaaaagaaaaaagagaacggagcccactagccactccttcaaacgtgtcttaccaactctcttctagaaacaaattaggcttcaccttcctcttccaacctctctctctctctctctctctttttctcaaaccatctctccataaagccctaatttcttcatcacaagaatcagaagaagaaagatggacctgcatctaattttcggtccaacttgcacaggaaagacgacgaccgcgatagctcttgcccagcagacagggcttccagtcctttcgcttgatcgggtccaatgctgtcctcaactatcaaccggaagcggacgaccaacagtggaagaactgaaaggaacgacgcgtctctaccttgatgatcggcctctggtggagggtatcatcgcagccaagcaagctcatcataggctgatcgaggaggtgtataatcatgaggccaacggcgggcttattcttgagggaggatccacctcgttgctcaactgcatggcgcgaaacagctattggagtgcagattttcgttggcatattattcgccacaagttacccgaccaagagaccttcatgaaagcggccaaggccagagttaagcagatgttgcaccccgctgcaggccattctattattcaagagttggtttatctttggaatgaacctcggctgaggcccattctgaaagagatcgatggatatcgatatgccatgttgtttgctagccagaaccagatcacggcagatatgctattgcagcttgacgcaaatatggaaggtaagttgattaatgggatcgctcaggagtatttcatccatgcgcgccaacaggaacagaaattcccccaagttaacgcagccgctttcgacggattcgaaggtcatccgttcggaatgtattagaaatcaccagtctctctctacaaatctatctctctctatttttctccagaataatgtgtgagtagttcccagataagggaattagggttcttatagggtttcgctcatgtgttgagcatataagaaacccttagtatgtatttgtatttgtaaaatacttctatcaataaaatttctaattcctaaaaccaaaatccagtgtttaaacgagtccatgctcaacaccgtgcactagggacaggattgaagactcccgcccatctcactagggacaggattgccaccccacagtggggcctagaaagactggagttgcagacattaaggatgaccagttcgtaaaggtcctgcggtgtctattgcttttcataggttaataagtgtttgctagactgtggtgaaaggcctatccgaagtaaggccggccggatccttcatctttggacaagggaataaagactccccacttgctactaagaacaatacctaagttgcccagacatgactgtacccattcagagacctaccacccattagggctatgacactaacactagcccctggaggttgaccatgctaggcagtgggggtctcacctatgacccactcagataggggtttaaaccagtgggtgggatctcagcctcatataggtgtttgtggtgagctttctcctagacaagagaaccctgaagaacagcaagaaccagctaatatgatatgtagacatagtgggttgctcaaattttgtgtttagtcatattagaattgacctcagtgaccactcagaaagtgcccaagcccatctataggggccaaagtgctattgactggtgtgtctgtgaattgttcctccctacagagttggtgctgatatatcctagcattctttggaaaacctagctagggactgtcaagtgtaagatacctcctgaattggagggaacactagctgccctgtaccttctggctagtaccttacaccctgaatgggttagggggtctattatttgctggaaatataccagtttcagtagggctgctgccttaggtcccacaaggtgtaacatgtgctcaatagttgcactaccacatgcacgtgaacttaatgatgttatagccacaacaccaaccttggtttgcagtttgacatccctctggaatgggtgtagtcatcttgctctggatctgcctgaatcattggggctgtatgcagcctgggcttaaagtgaagaatgggatgtcccagaaatattttgggtgagaagaatcctggagtagatggtgacctgactatccctgtcctatgggcacaatctatcatcagatattgcattcaaagggctatcatgggatcaagtcctaagtcaactgttgtttacctggcagacattcatctaggagttctcttttatgccaccccacagtgatccgccttttgcagtttatccactagggacaggattgccaccccacagtggggcctctatgcccgggacaagtgtaaaatatagagtataggggttatcatcacagagaagctattgctggagggcctctgttatttcctctccatgccactcccatttttaacctaccaactgaaatcccaagggagactccaccctgtaactagagtcctcagaggtgagccatcccatattaacaaatgggcattagggctaggatgccaagggatacctgaaatgggaagttgtggggctgagtcctcctgggaatcagagataatatgtaaacagtttgttgagagattgatgagagctgactttgagaggtggccatgctccctggtcctcaatagggaaggcactacacaagaaacctgggtttgatcaactgcactgtgtcctactcacacattgtgtgcctggaaaaatgttacttagtatttggagggcctccagaacccccctgggtgcaagactgggtgctagtgactgggtgaatgagtcttggacacagtggccttgtctaggttgtgtgaggtggctaggcatcatggcaatacctcataattgatgagtgaggaaacaagactaagtccttgactcctcttattacatgacctggtggatattatgtttaaactctgcaagctggaatgagtactgggtgcagatcccctgggattctggctacaaaggtgaatgatagctagtctgtttattagtagccaaaaaagtcagtgaggggtgagtgccctgggatgttgttaagttcacattgcacacttggagaccctctccatccagtaacataccagagaaaactgaccaagccctcatgggtgtatgggaacaacaaacctcctggctacttcaagggcacataacaccagcaaggagcctgtcataaccaccatctcaaacaatagaacttcctaagtgaagcaatgacttcaaatctacttgaaggcatggagtataagccatgttcctttcagaggggactgtacttctgtagattactttccctcattaaccagatctggccggccgcatgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttagccttcaacgtctcggggagaccttacgacggcggcttcgcttgccatttccaccccaacgctcccatctacaacgaccgtgagcgtctccagatatacatctccgacgctggcatcctcgccgtctgctacggtctctaccgctacgctgctgtccaaggagttgcctcgatggtctgcttctacggagttcctcttctgattgtcaacgggttcttagttttgatcacttacttgcagcacacgcatccttccctgcctcactatgactcgtctgagtgggattggttgaggggagctttggccaccgttgacagagactacggaatcttgaacaaggtcttccacaatatcacggacacgcacgtggcgcatcacctgttctcgaccatgccgcattatcacgcgatggaagctacgaaggcgataaagccgatactgggagagtattatcagttcgatgggacgccggtggttaaggcgatgtggagggaggcgaaggagtgtatctatgtggaaccggacaggcaaggtgagaagaaaggtgtgttctggtacaacaataagttatgaagcaaagaagaaactgaacctttctcatctatgattgtctttgttttaagaagctatgtttctgtttcaataatctttaattatccattttgttgtgttttctgacattttggctaaaat

SEQ ID NO: 142 - DNA, 13462 bp, Artificial Sequence
  T-strand Insert Region  of pDAS000271
taaataaaaactgatggaagtctgtttcttaagtcaaatacatcacagtgatgtggcaactattttccctcaaattaatacgttttaaaaaaaatctatataaatgttggcatgtctacaatctacatgatatccatatggatcgttttttatgatttatacatagtcaggaaattttagcagaaacaaaatagagtacgaagactaacataatattttcgactacatgtattttttttgcgaaattgtaaatatcaatcagtgaaaatgaaaaaccatacaagttgactaccatttcggtgcacaatccttacttctaaggaaaaactaaagagaaacaaaagaagaaaatcttggtaaattttgataccattaccatggttacttatactcgataatgcaattttaaaatcttctgtaaattttatagcattgttttttttgtaacacatttctctaacttagttttcatcgaaatgaacgacgtaacaaagatacattgcgcacaggttaccgcaaaaatacaatttttattcttcaaagaataaaaaagtttcctaaattaagaaaaaaagaaaacagtttggtgtctctacacatcttctccctttatataaacaaaccacacataccccaaagtccatcaaactctctccaccacatttcactcagagcccacacagttttagagagagagaaacatccctcaaagctctctctttctccggcgatggttgtcgctatggaccagcgtagcaatgtgaacggagattccaaggacgaaaggtttgatccgagcgcacaaccaccgtttaagatcggagatataagggctgcgattcctaagcattgttgggtcaagagtcctttgagatccatgagctacgtcgcgagagacattttctccgtcgtggctctggccgtcgccgccgtgtattttgatagctggttcttctggcctctttattgggccgcccaaggaacccttttctgggccatcggtaccgccttttgcagtttatctctatgcccgggacaagtggagtccatgctcaacaccgtgcaggatgaggatgaccaccgcggtagcgacttcgtgggcgaggaaagcctttcgtccaaggtggtccctcctcgcaatcttgttggatggtgaatattataaaagcctgcccttctcgcgggtgtttaaacgtcgacctgcaggtcaacggatcaggatattcttgtttaagatgttgaactctatggaggtttgtatgaactgatgatctaggaccggataagttcccttcttcatagcgaacttattcaaagaatgttttgtgtatcattcttgttacattgttattaatgaaaaaatattattggtcattggactgaacacgagtgttaaatatggaccaggccccaaataagatccattgatatatgaattaaataacaagaataaatcgagtcaccaaaccacttgccttttttaacgagacttgttcaccaacttgatacaaaagtcattatcctatgcaaatcaataatcatacaaaaatatccaataacactaaaaaattaaaagaaatggataatttcacaatatgttatacgataaagaagttacttttccaagaaattcactgattttataagcccacttgcattagataaatggcaaaaaaaaacaaaaaggaaaagaaataaagcacgaagaattctagaaaatacgaaatacgcttcaatgcagtgggacccacggttcaattattgccaattttcagctccaccgtatatttaaaaaataaaacgataatgctaaaaaaatataaatcgtaacgatcgttaaatctcaacggctggatcttatgacgaccgttagaaattgtggttgtcgacgagtcagtaataaacggcgtcaaagtggttgcagccggcacacacgagtcgtgtttatcaactcaaagcacaaatacttttcctcaacctaaaaataaggcaattagccaaaaacaactttgcgtgtaaacaacgctcaatacacgtgtcattttattattagctattgcttcaccgccttagctttctcgtgacctagtcgtcctcgtcttttcttcttcttcttctataaaacaatacccaaagagctcttcttcttcacaattcagatttcaatttctcaaaatcttaaaaactttctctcaattctctctaccgtgatcaaggtaaatttctgtgttccttattctctcaaaatcttcgattttgttttcgttcgatcccaatttcgtatatgttctttggtttagattctgttaatcttagatcgaagacgattttctgggtttgatcgttagatatcatcttaattctcgattagggtttcatagatatcatccgatttgttcaaataatttgagttttgtcgaataattactcttcgatttgtgatttctatctagatctggtgttagtttctagtttgtgcgatcgaatttgtcgattaatctgagtttttctgattaacagatggcttcatctgagaacgttatcactgagttcatgaggttcaaggtgaggatggaaggtactgttaacggacatgagttcgagatcgagggtgagggtgaaggtagaccttacgagggacataacaccgttaagcttaaggttacaaagggtggacctcttcctttcgcttgggatatcctttctcctcaattccaatacggaagcaaggtaagtttgtggattcttcgtccatgtgatctttgagtttctttagagcttgtgagggattagtaagtaacaatgcttgagttttttgctgctgggcttcgaaaagtttgtcacttgttggtttgatccacaaggtcttcttctccatagctactagacatgttttagcttaagattcaagtttatatatgccttgtggattaatcattgcctgattcttccgtgtcatctctgagtttatttagagcttggaagtggtgtagtaataactaacaatactcttgataagttgtagcaatgctcttgattagtggatgtaatatgatgttgataagatatatgaggcacagaaccaaaagtggtgcttccactagacccgtttttagcctaaggttcaagtttataccttgtagatgtttctgtattgtctgattcttccctgtgatatttgaatttcttagagctttggaagtgatataggaacaatgctcttgtgtgtttgtctctatgaagattatcgctgtcgtgtttcatccgagtgtgcgggattttttgctgctgggtttagcctttcttcaaaaagttattacttgttagttttattgttttggtcttgataagagatgttaggacagacatggtgcttcttgtctatagccactagacctattttagcataaggttaacgaaattctctctacataccttgtggatttgtttacattgcctgatctttcctgtgatcgctgtcatgtttctttggaatgattgatgtttataaatggaaaaatctttgtgcagaagactcccgcccatctctctatgcccgggacaagtgccaccccacagtggggcaggatgaggatgaccaccatggggtcgcagcgtgtgcgtgtccgtcgtacgttctggccggccgggccttgggcgcgcgatcagaagcgttgcgttggcgtgtgtgtgcttctggtttgctttaattttaccaagtttgtttcaaggtggatcgcgtggtcaaggcccgtgtgctttaaagacccaccggcactggcagtgagtgttgctgcttgtgtaggctttggtacgtatgggctttatttgcttctggatgttgtgtactacttgggtttgttgaattattatgagcagttgcgtattgtaattcagctgggctacctggacattgttatgtattaataaatgctttgctttcttctaaagatctttaagtgctgtttaaacaaccgacaaccactttgcggacttcctttcaagagaattcaataaggttaattcctaattgaaatccgaagataagattcccacacacttgtggctgatatcaaaaggctactgcctatttaaacacatctctggagactgagaaaatcagacctccaagcatgaagaagcctgagcttactgctacttctgttgagaagttcctcatcgagaagttcgattctgtgtctgatcttatgcagctctctgagggtgaggaatcaagagctttctctttcgatgttggtggaagaggatacgttctcagagttaactcttgcgctgacggattctacaaggatagatacgtgtacagacacttcgcttcagctgctctccctatccctgaagttcttgatatcggagagttctctgagtctcttacctactgtatctcaagaagggctcagggtgttactcttcaagatcttcctgagactgagcttcctgctgttcttcaacctgttgctgaggctatggatgctatcgctgctgctgatctttctcaaacttctggattcggacctttcggtcctcagggaatcggacagtacactacttggagagatttcatctgcgctatcgctgatcctcatgtttaccattggcagaccgttatggatgataccgtttctgcttctgttgctcaagctcttgatgagcttatgctttgggctgaggattgtcctgaggttagacatcttgttcacgctgatttcggatctaacaacgttctcaccgataacggaagaatcaccgctgttatcgattggtctgaggctatgttcggagattctcaatacgaggtggccaacatattcttttggaggccttggcttgcttgtatggaacaacagactagatacttcgagagaaggcatcctgagcttgctggatctcctagacttagagcttacatgcttaggatcggacttgatcagctttaccagtctctcgttgatggaaacttcgatgatgctgcttgggctcagggaagatgtgatgctatcgttagatctggtgctggaactgttggaagaactcaaatcgctagaagatctgctgctgtttggactgatggatgtgttgaagttctcgctgattctggaaacagaaggccttctactagacctagagccaagaagtgaagatcggcggcaatagcttcttagcgccatcccgggttgatcctatctgtgttgaaatagttgcggtgggcaaggctctctttcagaaagacaggcggccaaaggaacccaaggtgaggtgggctatggctctcagttccttgtggaagcgcttggtctaaggtgcagaggtgttagcgggatgaagcaaaagtgtccgattgtaacaagatatgttgatcctacgtaaggatattaaagtatgtattcatcactaatataatcagtgtattccaatatgtactacgatttccaatgtctttattgtcgccgtatgtaatcggcgtcacaaaataatccccggtgactttcttttaatccaggatgaaataatatgttattataatttttgcgatttggtccgttataggaattgaagtgtgcttgcggtcgccaccactcccatttcataattttacatgtatttgaaaaataaaaatttatggtattcaatttaaacacgtatacttgtaaagaatgatatcttgaaagaaatatagtttaaatatttattgataaaataacaagtcaggtattatagtccaagcaaaaacataaatttattgatgcaagtttaaattcagaaatatttcaataactgattatatcagctggtacattgccgtagatgaaagactgagtgcgatattatggtgtaatacatagtttaaacgggcccaagactcccgcccatctctctatgcccgggacaagtgccaccccacagtggggcaggatgaggatgaccagtcagttttacttcccttaattttctatgtactttcataattacttatgttattttcttcatgagttttaatgcaaattactatatggactctagtgaaaacgttcagaatcctataaacatgactactgagacgaacttgagagtagttttgatcatacacacgtttcatgtggtacttgagagttactaatttttgtcatcttcgtataagtagtaaaagatactacaagaatagtttagtagaaaatactagcggtaggtgaagatttgtcgctatgtactattattgtctagtaacttgagtaacaatttcgtggtctaaatatcaaataaaaatggatgagtggttcaccaaatctaggcatcaaaactattaatgtcattgtctagatcttaggtgacaccacatttcgaatatttattggtaattgagatgttaaagtaccaatatttgacttaataaactaaaagattttggctttatcaaatgtagacattgatgacatatcgttgtcattatcttgagtatatacaagtcgatcaattaggtgaaagtttagtgtctcgtggttggtaaacgattaatacagtagtatattttatccaaagacaaaatccaaatcatttcaccagtatgaatagtattattttatcttaaaagctaaaatcttaaaaaccaaggtagcacccacgttgagctagacgatcaaatcgatttctgctttgtccaatttaccaagctatttaaagccaaataattgaaatataggtaggtcgttatattaggctaagatttatctcaaatgcttaactaaaggaataacaagggattctagttgtgtggttttataagattggtccaatttcacttaagtttgtttattgtagaattttatatgtgaataatttgaattccaattgaaaagatattatagtaaaagaaaaaatagtgcgaacaaaaaactttaatcccataaaaagaaaaagaaaaatgaaaagttcttctaacatccatattttgcatcatatcataaagataagaaagatacatatcatagacgtacagataaacaaacatatcatcatttgtgaaatacatagtacaataatttgcttttaaatagagtttaagtcacacacactgacacacacgataaaacgataatgtctgcaaaaacactttaatcccattgcctagaggacagcttctccactttgtctttaaggttggttttgccgtgttgtttttatctttatataatgatctattttttggattatgaaatgaattcacacattttaattatttaagaagatccatatacaggtttataacagtactaagtgatgattattttttgtttttgcatagtttagtttattgggtaaacattcattacgtgtctctttatacgaatcacccatccaaaatttcaagtagtcttttagttcatttattatttcataactatttgacttattgatttgacaagaaacaacaaaagtgttgacttattgatagattgtgggatcataaaagtaattaagcgtcaaccacgacccacaacaacaaagcacatgttatacattaatatctcgtttacttaattacagttttcagaatgccgtttcatgtcttgtcactggcgatgttattatcatgttggacaatattcgactgttgtcgtttttacattttcgtattgactaaaactaaaaaaacaaaactctgtttcaggttgggcctaggatccacattgtacacacatttgcttaagtctatggaggcgcaaggttttaagtctgtggttgctgttataggccttccaaacgatccatctgttaggttgcatgaggctttgggatacacagcccggggtacattgcgcgcagctggatacaagcatggtggatggcatgatgttggtttttggcaaagggattttgagttgccagctcctccaaggccagttaggccagttacccagatctaatatcaaaatctatttagaaatacacaatattttgttgcaggcttgctggagaatcgatctgctatcataaaaattacaaaaaaattttatttgcctcaattattttaggattggtattaaggacgcttaaattatttgtcgggtcactacgcatcattgtgattgagaagatcagcgatacgaaatattcgtagtactatcgataatttatttgaaaattcataagaaaagcaaacgttacatgaattgatgaaacaatacaaagacagataaagccacgcacatttaggatattggccgagattactgaatattgagtaagatcacggaatttctgacaggagcatgtcttcaattcagcccaaatggcagttgaaatactcaaaccgccccatatgcaggagcggatcattcattgtttgtttggttgcctttgccaacatgggagtccaaggttgtttaaacatttaaataccctgccaagcttgaggtagcctccaatttgacggtgccgccagcgacgccgtctggaactgtcctttttgaggaccactccgtttgtggagatcatgagagtccatgctcaacaccgtgcactagggacaggattgaagactcccgcccatctcactagggacaggattgccaccccacagtggggcctagaaagactggagttgcagagtttgtgtcttctagattaatcctccaaacttttgattaaccaaaaaaattatcaaactaacatgttctccttttttctttagaaattctaacgaatttatctttatactgatttgaatatacttaatttggtcatttggatgccctttacaacctccttaccaaactattgatcacagtttctattgctaaaatcaccaacaaaacgcatgtcgccattcataattatggtttcacacctacaactaggctaataagtaaataagtagacaactagactcaggtttgaaaaaaccataaaagccatatagcgttttctcattgaaactgcgaacacgatcgtgtgaatgttgcagtttctagttttgatacaaacaaacaaaaacacaatttaatcttagattaaaaagaaaaaagagaacggagcccactagccactccttcaaacgtgtcttaccaactctcttctagaaacaaattaggcttcaccttcctcttccaacctctctctctctctctctctctttttctcaaaccatctctccataaagccctaatttcttcatcacaagaatcagaagaagaaagatggacctgcatctaattttcggtccaacttgcacaggaaagacgacgaccgcgatagctcttgcccagcagacagggcttccagtcctttcgcttgatcgggtccaatgctgtcctcaactatcaaccggaagcggacgaccaacagtggaagaactgaaaggaacgacgcgtctctaccttgatgatcggcctctggtggagggtatcatcgcagccaagcaagctcatcataggctgatcgaggaggtgtataatcatgaggccaacggcgggcttattcttgagggaggatccacctcgttgctcaactgcatggcgcgaaacagctattggagtgcagattttcgttggcatattattcgccacaagttacccgaccaagagaccttcatgaaagcggccaaggccagagttaagcagatgttgcaccccgctgcaggccattctattattcaagagttggtttatctttggaatgaacctcggctgaggcccattctgaaagagatcgatggatatcgatatgccatgttgtttgctagccagaaccagatcacggcagatatgctattgcagcttgacgcaaatatggaaggtaagttgattaatgggatcgctcaggagtatttcatccatgcgcgccaacaggaacagaaattcccccaagttaacgcagccgctttcgacggattcgaaggtcatccgttcggaatgtattagaaatcaccagtctctctctacaaatctatctctctctatttttctccagaataatgtgtgagtagttcccagataagggaattagggttcttatagggtttcgctcatgtgttgagcatataagaaacccttagtatgtatttgtatttgtaaaatacttctatcaataaaatttctaattcctaaaaccaaaatccagtgtttaaacgagtccatgctcaacaccgtgcactagggacaggattgaagactcccgcccatctcactagggacaggattgccaccccacagtggggcctagaaagactggagttgcagacattaaggatgaccagttcgtaaaggtcctgcggtgtctattgcttttcataggttaataagtgtttgctagactgtggtgaaaggcctatccgaagtaaggccggccggatccttcatctttggacaagggaataaagactccccacttgctactaagaacaatacctaagttgcccagacatgactgtacccattcagagacctaccacccattagggctatgacactaacactagcccctggaggttgaccatgctaggcagtgggggtctcacctatgacccactcagataggggtttaaaccagtgggtgggatctcagcctcatataggtgtttgtggtgagctttctcctagacaagagaaccctgaagaacagcaagaaccagctaatatgatatgtagacatagtgggttgctcaaattttgtgtttagtcatattagaattgacctcagtgaccactcagaaagtgcccaagcccatctataggggccaaagtgctattgactggtgtgtctgtgaattgttcctccctacagagttggtgctgatatatcctagcattctttggaaaacctagctagggactgtcaagtgtaagatacctcctgaattggagggaacactagctgccctgtaccttctggctagtaccttacaccctgaatgggttagggggtctattatttgctggaaatataccagtttcagtagggctgctgccttaggtcccacaaggtgtaacatgtgctcaatagttgcactaccacatgcacgtgaacttaatgatgttatagccacaacaccaaccttggtttgcagtttgacatccctctggaatgggtgtagtcatcttgctctggatctgcctgaatcattggggctgtatgcagcctgggcttaaagtgaagaatgggatgtcccagaaatattttgggtgagaagaatcctggagtagatggtgacctgactatccctgtcctatgggcacaatctatcatcagatattgcattcaaagggctatcatgggatcaagtcctaagtcaactgttgtttacctggcagacattcatctaggagttctcttttatgccaccccacagtgatccgccttttgcagtttatccactagggacaggattgccaccccacagtggggcctctatgcccgggacaagtgtaaaatatagagtataggggttatcatcacagagaagctattgctggagggcctctgttatttcctctccatgccactcccatttttaacctaccaactgaaatcccaagggagactccaccctgtaactagagtcctcagaggtgagccatcccatattaacaaatgggcattagggctaggatgccaagggatacctgaaatgggaagttgtggggctgagtcctcctgggaatcagagataatatgtaaacagtttgttgagagattgatgagagctgactttgagaggtggccatgctccctggtcctcaatagggaaggcactacacaagaaacctgggtttgatcaactgcactgtgtcctactcacacattgtgtgcctggaaaaatgttacttagtatttggagggcctccagaacccccctgggtgcaagactgggtgctagtgactgggtgaatgagtcttggacacagtggccttgtctaggttgtgtgaggtggctaggcatcatggcaatacctcataattgatgagtgaggaaacaagactaagtccttgactcctcttattacatgacctggtggatattatgtttaaactctgcaagctggaatgagtactgggtgcagatcccctgggattctggctacaaaggtgaatgatagctagtctgtttattagtagccaaaaaagtcagtgaggggtgagtgccctgggatgttgttaagttcacattgcacacttggagaccctctccatccagtaacataccagagaaaactgaccaagccctcatgggtgtatgggaacaacaaacctcctggctacttcaagggcacataacaccagcaaggagcctgtcataaccaccatctcaaacaatagaacttcctaagtgaagcaatgacttcaaatctacttgaaggcatggagtataagccatgttcctttcagaggggactgtacttctgtagattactttccctcattaaccagatctggccggccgcatgcgtactcggccacgactggtaatttaattttcaatttattttttcttcaacttcttaattttgatatgtttatatgttttttcgttttttgcatcgtctttgatttcttgaacgcacgttcgatatgagattttcactgacttcaagatttgattctcttcaggtttacttttaaaaaaaaaaattattatgttcacccaaattggcctattttaaaagcaaaaggggatctaagatttttaattcttctctttttcagtcgtaacactgctaacttttttttttgatcaaatcgtaacactcataagtcctaactaaacatctttttctttcctataattattgttggttccgcattttatggatctacgtttgaaagtttcaataaaacacattttattgtttgaaagtaacaatataattactgtatattgattcttttaattattgtgtgttgttccaatctactttcgaaatatagtcatgtgacacgtcatattctatttttgttaccttgttggaacgtttgaattgagtaaagtttaattaacattgtgcaataaatgataaacatgtttatgatgtaaaattcaatttgaataatacagtggacatgggagcttctcagacattcctcttctgaatactgcggttggtcatattcttcattccttcattctcgttccataccatggttggtaagtcatttatttaaacatctttttcatgcaaatttattcttgttttcgtatttcttacattttccttgtcattcttggtgcatgttagcaaactgtaatctgataactgaaaatatattaattttccatagtaaaataatgcatgtgactaaaagcatcaaaatctttagcatcgaagaaaaaagaaccaaacttttatttaatgctatgggcctatttatggtccaattagctattatcatatgacatgtccttgaataaattaatgtagcttcatatgtgagtttaataatatttata

SEQ ID NO: 143 - DNA, 13462 bp, Artificial Sequence
  T-strand Insert Region  of pDAS000272
ggtttcttttttaatttaatttatttttttaatcggagaaaaaaattaagaaaccaaaaaacagttttaatcatggcctcatgttggggttgagttttatattctgataagaatcccatcttaaaaaccccgttaaacatgctcttaccatctgcttcgaaaatgatatgttattgacaattccaatttcatttttatgaaaataaaataatagtttattttataactgagggtggttgcaggagaataagccatcggacacaccaccagaaccatggccatgttgaaaacgacgagtcttgggttccggtaatctttccctctctcatattttttttcttttttttgaaattctttcattttaattttcttaggattctatgtatttattttaatcaatcctttttccagtttgaggctaggacgaccacttgtcagatttgtcgtttagctgtagtaaacaactgatttaaattgtttatagtactgtagttaactttaacaacggaccacttatattcgagccattggcataaaatgattcttctcgaaattcgtttacttttcttagtatttttcaattttggagtttacgtagaactaataaaaagaaaaacttataaacacaccacatgcaatgaataaattcgaatatataaccatactgttaaatattaatttacattttaatcttaattttgcattccagttgccagaaaaattatacaagaatttgtcccacagtacacggatgctcagatacactgtccctctccccatgctcgcttaccctctctatctggtaaatcctaattcctaatttttcttcctgattataattacaattttgaatttttagattttgagtattaactaaatataaattaaatttgtttggggatgactacagtggtacagaagtcctggtaaagaagggtcacattataacccatacagtagtttatttgccccaagcgagagaaagcttattgcaacttcaggtaccgccttttgcagtttatctctatgcccgggacaagtggagtccatgctcaacaccgtgcaggatgaggatgaccaccgcggtagcgacttcgtgggcgaggaaagcctttcgtccaaggtggtccctcctcgcaatcttgttggatggtgaatattataaaagcctgcccttctcgcgggtgtttaaacgtcgacctgcaggtcaacggatcaggatattcttgtttaagatgttgaactctatggaggtttgtatgaactgatgatctaggaccggataagttcccttcttcatagcgaacttattcaaagaatgttttgtgtatcattcttgttacattgttattaatgaaaaaatattattggtcattggactgaacacgagtgttaaatatggaccaggccccaaataagatccattgatatatgaattaaataacaagaataaatcgagtcaccaaaccacttgccttttttaacgagacttgttcaccaacttgatacaaaagtcattatcctatgcaaatcaataatcatacaaaaatatccaataacactaaaaaattaaaagaaatggataatttcacaatatgttatacgataaagaagttacttttccaagaaattcactgattttataagcccacttgcattagataaatggcaaaaaaaaacaaaaaggaaaagaaataaagcacgaagaattctagaaaatacgaaatacgcttcaatgcagtgggacccacggttcaattattgccaattttcagctccaccgtatatttaaaaaataaaacgataatgctaaaaaaatataaatcgtaacgatcgttaaatctcaacggctggatcttatgacgaccgttagaaattgtggttgtcgacgagtcagtaataaacggcgtcaaagtggttgcagccggcacacacgagtcgtgtttatcaactcaaagcacaaatacttttcctcaacctaaaaataaggcaattagccaaaaacaactttgcgtgtaaacaacgctcaatacacgtgtcattttattattagctattgcttcaccgccttagctttctcgtgacctagtcgtcctcgtcttttcttcttcttcttctataaaacaatacccaaagagctcttcttcttcacaattcagatttcaatttctcaaaatcttaaaaactttctctcaattctctctaccgtgatcaaggtaaatttctgtgttccttattctctcaaaatcttcgattttgttttcgttcgatcccaatttcgtatatgttctttggtttagattctgttaatcttagatcgaagacgattttctgggtttgatcgttagatatcatcttaattctcgattagggtttcatagatatcatccgatttgttcaaataatttgagttttgtcgaataattactcttcgatttgtgatttctatctagatctggtgttagtttctagtttgtgcgatcgaatttgtcgattaatctgagtttttctgattaacagatggcttcatctgagaacgttatcactgagttcatgaggttcaaggtgaggatggaaggtactgttaacggacatgagttcgagatcgagggtgagggtgaaggtagaccttacgagggacataacaccgttaagcttaaggttacaaagggtggacctcttcctttcgcttgggatatcctttctcctcaattccaatacggaagcaaggtaagtttgtggattcttcgtccatgtgatctttgagtttctttagagcttgtgagggattagtaagtaacaatgcttgagttttttgctgctgggcttcgaaaagtttgtcacttgttggtttgatccacaaggtcttcttctccatagctactagacatgttttagcttaagattcaagtttatatatgccttgtggattaatcattgcctgattcttccgtgtcatctctgagtttatttagagcttggaagtggtgtagtaataactaacaatactcttgataagttgtagcaatgctcttgattagtggatgtaatatgatgttgataagatatatgaggcacagaaccaaaagtggtgcttccactagacccgtttttagcctaaggttcaagtttataccttgtagatgtttctgtattgtctgattcttccctgtgatatttgaatttcttagagctttggaagtgatataggaacaatgctcttgtgtgtttgtctctatgaagattatcgctgtcgtgtttcatccgagtgtgcgggattttttgctgctgggtttagcctttcttcaaaaagttattacttgttagttttattgttttggtcttgataagagatgttaggacagacatggtgcttcttgtctatagccactagacctattttagcataaggttaacgaaattctctctacataccttgtggatttgtttacattgcctgatctttcctgtgatcgctgtcatgtttctttggaatgattgatgtttataaatggaaaaatctttgtgcagaagactcccgcccatctctctatgcccgggacaagtgccaccccacagtggggcaggatgaggatgaccaccatggggtcgcagcgtgtgcgtgtccgtcgtacgttctggccggccgggccttgggcgcgcgatcagaagcgttgcgttggcgtgtgtgtgcttctggtttgctttaattttaccaagtttgtttcaaggtggatcgcgtggtcaaggcccgtgtgctttaaagacccaccggcactggcagtgagtgttgctgcttgtgtaggctttggtacgtatgggctttatttgcttctggatgttgtgtactacttgggtttgttgaattattatgagcagttgcgtattgtaattcagctgggctacctggacattgttatgtattaataaatgctttgctttcttctaaagatctttaagtgctgtttaaacaaccgacaaccactttgcggacttcctttcaagagaattcaataaggttaattcctaattgaaatccgaagataagattcccacacacttgtggctgatatcaaaaggctactgcctatttaaacacatctctggagactgagaaaatcagacctccaagcatgaagaagcctgagcttactgctacttctgttgagaagttcctcatcgagaagttcgattctgtgtctgatcttatgcagctctctgagggtgaggaatcaagagctttctctttcgatgttggtggaagaggatacgttctcagagttaactcttgcgctgacggattctacaaggatagatacgtgtacagacacttcgcttcagctgctctccctatccctgaagttcttgatatcggagagttctctgagtctcttacctactgtatctcaagaagggctcagggtgttactcttcaagatcttcctgagactgagcttcctgctgttcttcaacctgttgctgaggctatggatgctatcgctgctgctgatctttctcaaacttctggattcggacctttcggtcctcagggaatcggacagtacactacttggagagatttcatctgcgctatcgctgatcctcatgtttaccattggcagaccgttatggatgataccgtttctgcttctgttgctcaagctcttgatgagcttatgctttgggctgaggattgtcctgaggttagacatcttgttcacgctgatttcggatctaacaacgttctcaccgataacggaagaatcaccgctgttatcgattggtctgaggctatgttcggagattctcaatacgaggtggccaacatattcttttggaggccttggcttgcttgtatggaacaacagactagatacttcgagagaaggcatcctgagcttgctggatctcctagacttagagcttacatgcttaggatcggacttgatcagctttaccagtctctcgttgatggaaacttcgatgatgctgcttgggctcagggaagatgtgatgctatcgttagatctggtgctggaactgttggaagaactcaaatcgctagaagatctgctgctgtttggactgatggatgtgttgaagttctcgctgattctggaaacagaaggccttctactagacctagagccaagaagtgaagatcggcggcaatagcttcttagcgccatcccgggttgatcctatctgtgttgaaatagttgcggtgggcaaggctctctttcagaaagacaggcggccaaaggaacccaaggtgaggtgggctatggctctcagttccttgtggaagcgcttggtctaaggtgcagaggtgttagcgggatgaagcaaaagtgtccgattgtaacaagatatgttgatcctacgtaaggatattaaagtatgtattcatcactaatataatcagtgtattccaatatgtactacgatttccaatgtctttattgtcgccgtatgtaatcggcgtcacaaaataatccccggtgactttcttttaatccaggatgaaataatatgttattataatttttgcgatttggtccgttataggaattgaagtgtgcttgcggtcgccaccactcccatttcataattttacatgtatttgaaaaataaaaatttatggtattcaatttaaacacgtatacttgtaaagaatgatatcttgaaagaaatatagtttaaatatttattgataaaataacaagtcaggtattatagtccaagcaaaaacataaatttattgatgcaagtttaaattcagaaatatttcaataactgattatatcagctggtacattgccgtagatgaaagactgagtgcgatattatggtgtaatacatagtttaaacgggcccaagactcccgcccatctctctatgcccgggacaagtgccaccccacagtggggcaggatgaggatgaccagtcagttttacttcccttaattttctatgtactttcataattacttatgttattttcttcatgagttttaatgcaaattactatatggactctagtgaaaacgttcagaatcctataaacatgactactgagacgaacttgagagtagttttgatcatacacacgtttcatgtggtacttgagagttactaatttttgtcatcttcgtataagtagtaaaagatactacaagaatagtttagtagaaaatactagcggtaggtgaagatttgtcgctatgtactattattgtctagtaacttgagtaacaatttcgtggtctaaatatcaaataaaaatggatgagtggttcaccaaatctaggcatcaaaactattaatgtcattgtctagatcttaggtgacaccacatttcgaatatttattggtaattgagatgttaaagtaccaatatttgacttaataaactaaaagattttggctttatcaaatgtagacattgatgacatatcgttgtcattatcttgagtatatacaagtcgatcaattaggtgaaagtttagtgtctcgtggttggtaaacgattaatacagtagtatattttatccaaagacaaaatccaaatcatttcaccagtatgaatagtattattttatcttaaaagctaaaatcttaaaaaccaaggtagcacccacgttgagctagacgatcaaatcgatttctgctttgtccaatttaccaagctatttaaagccaaataattgaaatataggtaggtcgttatattaggctaagatttatctcaaatgcttaactaaaggaataacaagggattctagttgtgtggttttataagattggtccaatttcacttaagtttgtttattgtagaattttatatgtgaataatttgaattccaattgaaaagatattatagtaaaagaaaaaatagtgcgaacaaaaaactttaatcccataaaaagaaaaagaaaaatgaaaagttcttctaacatccatattttgcatcatatcataaagataagaaagatacatatcatagacgtacagataaacaaacatatcatcatttgtgaaatacatagtacaataatttgcttttaaatagagtttaagtcacacacactgacacacacgataaaacgataatgtctgcaaaaacactttaatcccattgcctagaggacagcttctccactttgtctttaaggttggttttgccgtgttgtttttatctttatataatgatctattttttggattatgaaatgaattcacacattttaattatttaagaagatccatatacaggtttataacagtactaagtgatgattattttttgtttttgcatagtttagtttattgggtaaacattcattacgtgtctctttatacgaatcacccatccaaaatttcaagtagtcttttagttcatttattatttcataactatttgacttattgatttgacaagaaacaacaaaagtgttgacttattgatagattgtgggatcataaaagtaattaagcgtcaaccacgacccacaacaacaaagcacatgttatacattaatatctcgtttacttaattacagttttcagaatgccgtttcatgtcttgtcactggcgatgttattatcatgttggacaatattcgactgttgtcgtttttacattttcgtattgactaaaactaaaaaaacaaaactctgtttcaggttgggcctaggatccacattgtacacacatttgcttaagtctatggaggcgcaaggttttaagtctgtggttgctgttataggccttccaaacgatccatctgttaggttgcatgaggctttgggatacacagcccggggtacattgcgcgcagctggatacaagcatggtggatggcatgatgttggtttttggcaaagggattttgagttgccagctcctccaaggccagttaggccagttacccagatctaatatcaaaatctatttagaaatacacaatattttgttgcaggcttgctggagaatcgatctgctatcataaaaattacaaaaaaattttatttgcctcaattattttaggattggtattaaggacgcttaaattatttgtcgggtcactacgcatcattgtgattgagaagatcagcgatacgaaatattcgtagtactatcgataatttatttgaaaattcataagaaaagcaaacgttacatgaattgatgaaacaatacaaagacagataaagccacgcacatttaggatattggccgagattactgaatattgagtaagatcacggaatttctgacaggagcatgtcttcaattcagcccaaatggcagttgaaatactcaaaccgccccatatgcaggagcggatcattcattgtttgtttggttgcctttgccaacatgggagtccaaggttgtttaaacatttaaataccctgccaagcttgaggtagcctccaatttgacggtgccgccagcgacgccgtctggaactgtcctttttgaggaccactccgtttgtggagatcatgagagtccatgctcaacaccgtgcactagggacaggattgaagactcccgcccatctcactagggacaggattgccaccccacagtggggcctagaaagactggagttgcagagtttgtgtcttctagattaatcctccaaacttttgattaaccaaaaaaattatcaaactaacatgttctccttttttctttagaaattctaacgaatttatctttatactgatttgaatatacttaatttggtcatttggatgccctttacaacctccttaccaaactattgatcacagtttctattgctaaaatcaccaacaaaacgcatgtcgccattcataattatggtttcacacctacaactaggctaataagtaaataagtagacaactagactcaggtttgaaaaaaccataaaagccatatagcgttttctcattgaaactgcgaacacgatcgtgtgaatgttgcagtttctagttttgatacaaacaaacaaaaacacaatttaatcttagattaaaaagaaaaaagagaacggagcccactagccactccttcaaacgtgtcttaccaactctcttctagaaacaaattaggcttcaccttcctcttccaacctctctctctctctctctctctttttctcaaaccatctctccataaagccctaatttcttcatcacaagaatcagaagaagaaagatggacctgcatctaattttcggtccaacttgcacaggaaagacgacgaccgcgatagctcttgcccagcagacagggcttccagtcctttcgcttgatcgggtccaatgctgtcctcaactatcaaccggaagcggacgaccaacagtggaagaactgaaaggaacgacgcgtctctaccttgatgatcggcctctggtggagggtatcatcgcagccaagcaagctcatcataggctgatcgaggaggtgtataatcatgaggccaacggcgggcttattcttgagggaggatccacctcgttgctcaactgcatggcgcgaaacagctattggagtgcagattttcgttggcatattattcgccacaagttacccgaccaagagaccttcatgaaagcggccaaggccagagttaagcagatgttgcaccccgctgcaggccattctattattcaagagttggtttatctttggaatgaacctcggctgaggcccattctgaaagagatcgatggatatcgatatgccatgttgtttgctagccagaaccagatcacggcagatatgctattgcagcttgacgcaaatatggaaggtaagttgattaatgggatcgctcaggagtatttcatccatgcgcgccaacaggaacagaaattcccccaagttaacgcagccgctttcgacggattcgaaggtcatccgttcggaatgtattagaaatcaccagtctctctctacaaatctatctctctctatttttctccagaataatgtgtgagtagttcccagataagggaattagggttcttatagggtttcgctcatgtgttgagcatataagaaacccttagtatgtatttgtatttgtaaaatacttctatcaataaaatttctaattcctaaaaccaaaatccagtgtttaaacgagtccatgctcaacaccgtgcactagggacaggattgaagactcccgcccatctcactagggacaggattgccaccccacagtggggcctagaaagactggagttgcagacattaaggatgaccagttcgtaaaggtcctgcggtgtctattgcttttcataggttaataagtgtttgctagactgtggtgaaaggcctatccgaagtaaggccggccggatccttcatctttggacaagggaataaagactccccacttgctactaagaacaatacctaagttgcccagacatgactgtacccattcagagacctaccacccattagggctatgacactaacactagcccctggaggttgaccatgctaggcagtgggggtctcacctatgacccactcagataggggtttaaaccagtgggtgggatctcagcctcatataggtgtttgtggtgagctttctcctagacaagagaaccctgaagaacagcaagaaccagctaatatgatatgtagacatagtgggttgctcaaattttgtgtttagtcatattagaattgacctcagtgaccactcagaaagtgcccaagcccatctataggggccaaagtgctattgactggtgtgtctgtgaattgttcctccctacagagttggtgctgatatatcctagcattctttggaaaacctagctagggactgtcaagtgtaagatacctcctgaattggagggaacactagctgccctgtaccttctggctagtaccttacaccctgaatgggttagggggtctattatttgctggaaatataccagtttcagtagggctgctgccttaggtcccacaaggtgtaacatgtgctcaatagttgcactaccacatgcacgtgaacttaatgatgttatagccacaacaccaaccttggtttgcagtttgacatccctctggaatgggtgtagtcatcttgctctggatctgcctgaatcattggggctgtatgcagcctgggcttaaagtgaagaatgggatgtcccagaaatattttgggtgagaagaatcctggagtagatggtgacctgactatccctgtcctatgggcacaatctatcatcagatattgcattcaaagggctatcatgggatcaagtcctaagtcaactgttgtttacctggcagacattcatctaggagttctcttttatgccaccccacagtgatccgccttttgcagtttatccactagggacaggattgccaccccacagtggggcctctatgcccgggacaagtgtaaaatatagagtataggggttatcatcacagagaagctattgctggagggcctctgttatttcctctccatgccactcccatttttaacctaccaactgaaatcccaagggagactccaccctgtaactagagtcctcagaggtgagccatcccatattaacaaatgggcattagggctaggatgccaagggatacctgaaatgggaagttgtggggctgagtcctcctgggaatcagagataatatgtaaacagtttgttgagagattgatgagagctgactttgagaggtggccatgctccctggtcctcaatagggaaggcactacacaagaaacctgggtttgatcaactgcactgtgtcctactcacacattgtgtgcctggaaaaatgttacttagtatttggagggcctccagaacccccctgggtgcaagactgggtgctagtgactgggtgaatgagtcttggacacagtggccttgtctaggttgtgtgaggtggctaggcatcatggcaatacctcataattgatgagtgaggaaacaagactaagtccttgactcctcttattacatgacctggtggatattatgtttaaactctgcaagctggaatgagtactgggtgcagatcccctgggattctggctacaaaggtgaatgatagctagtctgtttattagtagccaaaaaagtcagtgaggggtgagtgccctgggatgttgttaagttcacattgcacacttggagaccctctccatccagtaacataccagagaaaactgaccaagccctcatgggtgtatgggaacaacaaacctcctggctacttcaagggcacataacaccagcaaggagcctgtcataaccaccatctcaaacaatagaacttcctaagtgaagcaatgacttcaaatctacttgaaggcatggagtataagccatgttcctttcagaggggactgtacttctgtagattactttccctcattaaccagatctggccggccgcatgccttgctggtcgatcgtgttggccactcttgtttatctatcattcctcgttggtccagtcacagttctaaaagtctatggtgttccttacattgtaagtttcatatatttctttattatatcattgctaatataatttgtttttgacataaaagttttggaaaaatttcagatctttgtaatgtggttggacgctgtcacgtacttgcatcatcatggtcacgatgataagctgccttggtacagaggcaaggtaagtagatcaacattatttataagaagcaataatgattagtagttgaataatctgaatttttgatgtttttgtacaataataggaatggagttatttacgtggaggattaacaactgttgatagagattacgggatcttcaacaacattcatcacgatattggaactcacgtgatccatcatcttttcccacaaatccctcactatcacttggtcgatgccgtgagtgatctcgctctctctctagtttcatttgattatattaaagggtgattaattactaaattagtgatcttaattaatgacatgcgacagacgaaagcagctaaacatgtgttgggaagatactacagagaaccaaagacgtcaggagcaataccgatccacttagtggaaagtttggtggcaagtattaagaaagatcattacgtcagtgacactggtgatattgtcttctacgagacagatccagatctctacgtttatgcttctgacaaatccaaaatcaattaatctttcttcctagctctatttaggaataaaacactcctttggttttacttatttctggttgtttttaagttaaaaatgtactcgtgaaacttttttttattaaatgtatttacattacaaatcgtaaaagtttttgttcgttttctctatgtttttagttacaaacttacaatcaaaaaggtcttaaaaactttttgatggtgggacggacaaaagaaaaagttcgactgagagt

SEQ ID NO: 144 - DNA, 13462 bp, Artificial Sequence
  T-strand Insert Region of pDAS000273
aatatttatatatatttgttttaatggcttattttattgttaaatggatacatcagcttgaaatatctacgaacatgcatcattttcctagatacatttgtttgttgctcaaaaaatgaataacgtagttaaacgagtgagattcttagcatctgcctcgaaaacgatatgttattgacaattccaatttcatttttatgaaaataaaataatagtttattttataattgggggtggttgcaggagaataagccatcggacacaccaccagaaccatggccatgttgaaaacgacgagtcttgggttccggtaatccccctctcattatttttttttctttttttgaaactctttcattttaattttcttagaattctatgtatttattttaatcaatcctttttccagtgtgaggcttggacgaccacttgtcagatttgtcgtttagctgtagtaaacaactgatttaaattgtttatggtactgtagttaactttaacaacgggccacttatattcgagccattggcataaaatgattcttctcgaaattcgtttacttttcttagtatttttcagttttgtagtttacgtagaactaataaaaagaaaaaaacttataaacacaccacatgcaatgaataaattcgaatatataaccatactgttaaatattaattaacattttaatcttaattttgcattccagttgccagaaaaattatacaagaatttgtcccacagtacacggatgctcagatacactgtccctctccccatgctcgcttaccctctctatctggtaaatcctaattcctcatttttcttcctgattataattacaattttgaatttttagattttgagtattaactaaatataaattaaatttgtttggggatgactacagtggtacagaagtcctggtaaagaagggtcacattataacccatacagtagtttatttgccccaagcgagagaaagcttattgcaacttcaggtaccgccttttgcagtttatctctatgcccgggacaagtggagtccatgctcaacaccgtgcaggatgaggatgaccaccgcggtagcgacttcgtgggcgaggaaagcctttcgtccaaggtggtccctcctcgcaatcttgttggatggtgaatattataaaagcctgcccttctcgcgggtgtttaaacgtcgacctgcaggtcaacggatcaggatattcttgtttaagatgttgaactctatggaggtttgtatgaactgatgatctaggaccggataagttcccttcttcatagcgaacttattcaaagaatgttttgtgtatcattcttgttacattgttattaatgaaaaaatattattggtcattggactgaacacgagtgttaaatatggaccaggccccaaataagatccattgatatatgaattaaataacaagaataaatcgagtcaccaaaccacttgccttttttaacgagacttgttcaccaacttgatacaaaagtcattatcctatgcaaatcaataatcatacaaaaatatccaataacactaaaaaattaaaagaaatggataatttcacaatatgttatacgataaagaagttacttttccaagaaattcactgattttataagcccacttgcattagataaatggcaaaaaaaaacaaaaaggaaaagaaataaagcacgaagaattctagaaaatacgaaatacgcttcaatgcagtgggacccacggttcaattattgccaattttcagctccaccgtatatttaaaaaataaaacgataatgctaaaaaaatataaatcgtaacgatcgttaaatctcaacggctggatcttatgacgaccgttagaaattgtggttgtcgacgagtcagtaataaacggcgtcaaagtggttgcagccggcacacacgagtcgtgtttatcaactcaaagcacaaatacttttcctcaacctaaaaataaggcaattagccaaaaacaactttgcgtgtaaacaacgctcaatacacgtgtcattttattattagctattgcttcaccgccttagctttctcgtgacctagtcgtcctcgtcttttcttcttcttcttctataaaacaatacccaaagagctcttcttcttcacaattcagatttcaatttctcaaaatcttaaaaactttctctcaattctctctaccgtgatcaaggtaaatttctgtgttccttattctctcaaaatcttcgattttgttttcgttcgatcccaatttcgtatatgttctttggtttagattctgttaatcttagatcgaagacgattttctgggtttgatcgttagatatcatcttaattctcgattagggtttcatagatatcatccgatttgttcaaataatttgagttttgtcgaataattactcttcgatttgtgatttctatctagatctggtgttagtttctagtttgtgcgatcgaatttgtcgattaatctgagtttttctgattaacagatggcttcatctgagaacgttatcactgagttcatgaggttcaaggtgaggatggaaggtactgttaacggacatgagttcgagatcgagggtgagggtgaaggtagaccttacgagggacataacaccgttaagcttaaggttacaaagggtggacctcttcctttcgcttgggatatcctttctcctcaattccaatacggaagcaaggtaagtttgtggattcttcgtccatgtgatctttgagtttctttagagcttgtgagggattagtaagtaacaatgcttgagttttttgctgctgggcttcgaaaagtttgtcacttgttggtttgatccacaaggtcttcttctccatagctactagacatgttttagcttaagattcaagtttatatatgccttgtggattaatcattgcctgattcttccgtgtcatctctgagtttatttagagcttggaagtggtgtagtaataactaacaatactcttgataagttgtagcaatgctcttgattagtggatgtaatatgatgttgataagatatatgaggcacagaaccaaaagtggtgcttccactagacccgtttttagcctaaggttcaagtttataccttgtagatgtttctgtattgtctgattcttccctgtgatatttgaatttcttagagctttggaagtgatataggaacaatgctcttgtgtgtttgtctctatgaagattatcgctgtcgtgtttcatccgagtgtgcgggattttttgctgctgggtttagcctttcttcaaaaagttattacttgttagttttattgttttggtcttgataagagatgttaggacagacatggtgcttcttgtctatagccactagacctattttagcataaggttaacgaaattctctctacataccttgtggatttgtttacattgcctgatctttcctgtgatcgctgtcatgtttctttggaatgattgatgtttataaatggaaaaatctttgtgcagaagactcccgcccatctctctatgcccgggacaagtgccaccccacagtggggcaggatgaggatgaccaccatggggtcgcagcgtgtgcgtgtccgtcgtacgttctggccggccgggccttgggcgcgcgatcagaagcgttgcgttggcgtgtgtgtgcttctggtttgctttaattttaccaagtttgtttcaaggtggatcgcgtggtcaaggcccgtgtgctttaaagacccaccggcactggcagtgagtgttgctgcttgtgtaggctttggtacgtatgggctttatttgcttctggatgttgtgtactacttgggtttgttgaattattatgagcagttgcgtattgtaattcagctgggctacctggacattgttatgtattaataaatgctttgctttcttctaaagatctttaagtgctgtttaaacaaccgacaaccactttgcggacttcctttcaagagaattcaataaggttaattcctaattgaaatccgaagataagattcccacacacttgtggctgatatcaaaaggctactgcctatttaaacacatctctggagactgagaaaatcagacctccaagcatgaagaagcctgagcttactgctacttctgttgagaagttcctcatcgagaagttcgattctgtgtctgatcttatgcagctctctgagggtgaggaatcaagagctttctctttcgatgttggtggaagaggatacgttctcagagttaactcttgcgctgacggattctacaaggatagatacgtgtacagacacttcgcttcagctgctctccctatccctgaagttcttgatatcggagagttctctgagtctcttacctactgtatctcaagaagggctcagggtgttactcttcaagatcttcctgagactgagcttcctgctgttcttcaacctgttgctgaggctatggatgctatcgctgctgctgatctttctcaaacttctggattcggacctttcggtcctcagggaatcggacagtacactacttggagagatttcatctgcgctatcgctgatcctcatgtttaccattggcagaccgttatggatgataccgtttctgcttctgttgctcaagctcttgatgagcttatgctttgggctgaggattgtcctgaggttagacatcttgttcacgctgatttcggatctaacaacgttctcaccgataacggaagaatcaccgctgttatcgattggtctgaggctatgttcggagattctcaatacgaggtggccaacatattcttttggaggccttggcttgcttgtatggaacaacagactagatacttcgagagaaggcatcctgagcttgctggatctcctagacttagagcttacatgcttaggatcggacttgatcagctttaccagtctctcgttgatggaaacttcgatgatgctgcttgggctcagggaagatgtgatgctatcgttagatctggtgctggaactgttggaagaactcaaatcgctagaagatctgctgctgtttggactgatggatgtgttgaagttctcgctgattctggaaacagaaggccttctactagacctagagccaagaagtgaagatcggcggcaatagcttcttagcgccatcccgggttgatcctatctgtgttgaaatagttgcggtgggcaaggctctctttcagaaagacaggcggccaaaggaacccaaggtgaggtgggctatggctctcagttccttgtggaagcgcttggtctaaggtgcagaggtgttagcgggatgaagcaaaagtgtccgattgtaacaagatatgttgatcctacgtaaggatattaaagtatgtattcatcactaatataatcagtgtattccaatatgtactacgatttccaatgtctttattgtcgccgtatgtaatcggcgtcacaaaataatccccggtgactttcttttaatccaggatgaaataatatgttattataatttttgcgatttggtccgttataggaattgaagtgtgcttgcggtcgccaccactcccatttcataattttacatgtatttgaaaaataaaaatttatggtattcaatttaaacacgtatacttgtaaagaatgatatcttgaaagaaatatagtttaaatatttattgataaaataacaagtcaggtattatagtccaagcaaaaacataaatttattgatgcaagtttaaattcagaaatatttcaataactgattatatcagctggtacattgccgtagatgaaagactgagtgcgatattatggtgtaatacatagtttaaacgggcccaagactcccgcccatctctctatgcccgggacaagtgccaccccacagtggggcaggatgaggatgaccagtcagttttacttcccttaattttctatgtactttcataattacttatgttattttcttcatgagttttaatgcaaattactatatggactctagtgaaaacgttcagaatcctataaacatgactactgagacgaacttgagagtagttttgatcatacacacgtttcatgtggtacttgagagttactaatttttgtcatcttcgtataagtagtaaaagatactacaagaatagtttagtagaaaatactagcggtaggtgaagatttgtcgctatgtactattattgtctagtaacttgagtaacaatttcgtggtctaaatatcaaataaaaatggatgagtggttcaccaaatctaggcatcaaaactattaatgtcattgtctagatcttaggtgacaccacatttcgaatatttattggtaattgagatgttaaagtaccaatatttgacttaataaactaaaagattttggctttatcaaatgtagacattgatgacatatcgttgtcattatcttgagtatatacaagtcgatcaattaggtgaaagtttagtgtctcgtggttggtaaacgattaatacagtagtatattttatccaaagacaaaatccaaatcatttcaccagtatgaatagtattattttatcttaaaagctaaaatcttaaaaaccaaggtagcacccacgttgagctagacgatcaaatcgatttctgctttgtccaatttaccaagctatttaaagccaaataattgaaatataggtaggtcgttatattaggctaagatttatctcaaatgcttaactaaaggaataacaagggattctagttgtgtggttttataagattggtccaatttcacttaagtttgtttattgtagaattttatatgtgaataatttgaattccaattgaaaagatattatagtaaaagaaaaaatagtgcgaacaaaaaactttaatcccataaaaagaaaaagaaaaatgaaaagttcttctaacatccatattttgcatcatatcataaagataagaaagatacatatcatagacgtacagataaacaaacatatcatcatttgtgaaatacatagtacaataatttgcttttaaatagagtttaagtcacacacactgacacacacgataaaacgataatgtctgcaaaaacactttaatcccattgcctagaggacagcttctccactttgtctttaaggttggttttgccgtgttgtttttatctttatataatgatctattttttggattatgaaatgaattcacacattttaattatttaagaagatccatatacaggtttataacagtactaagtgatgattattttttgtttttgcatagtttagtttattgggtaaacattcattacgtgtctctttatacgaatcacccatccaaaatttcaagtagtcttttagttcatttattatttcataactatttgacttattgatttgacaagaaacaacaaaagtgttgacttattgatagattgtgggatcataaaagtaattaagcgtcaaccacgacccacaacaacaaagcacatgttatacattaatatctcgtttacttaattacagttttcagaatgccgtttcatgtcttgtcactggcgatgttattatcatgttggacaatattcgactgttgtcgtttttacattttcgtattgactaaaactaaaaaaacaaaactctgtttcaggttgggcctaggatccacattgtacacacatttgcttaagtctatggaggcgcaaggttttaagtctgtggttgctgttataggccttccaaacgatccatctgttaggttgcatgaggctttgggatacacagcccggggtacattgcgcgcagctggatacaagcatggtggatggcatgatgttggtttttggcaaagggattttgagttgccagctcctccaaggccagttaggccagttacccagatctaatatcaaaatctatttagaaatacacaatattttgttgcaggcttgctggagaatcgatctgctatcataaaaattacaaaaaaattttatttgcctcaattattttaggattggtattaaggacgcttaaattatttgtcgggtcactacgcatcattgtgattgagaagatcagcgatacgaaatattcgtagtactatcgataatttatttgaaaattcataagaaaagcaaacgttacatgaattgatgaaacaatacaaagacagataaagccacgcacatttaggatattggccgagattactgaatattgagtaagatcacggaatttctgacaggagcatgtcttcaattcagcccaaatggcagttgaaatactcaaaccgccccatatgcaggagcggatcattcattgtttgtttggttgcctttgccaacatgggagtccaaggttgtttaaacatttaaataccctgccaagcttgaggtagcctccaatttgacggtgccgccagcgacgccgtctggaactgtcctttttgaggaccactccgtttgtggagatcatgagagtccatgctcaacaccgtgcactagggacaggattgaagactcccgcccatctcactagggacaggattgccaccccacagtggggcctagaaagactggagttgcagagtttgtgtcttctagattaatcctccaaacttttgattaaccaaaaaaattatcaaactaacatgttctccttttttctttagaaattctaacgaatttatctttatactgatttgaatatacttaatttggtcatttggatgccctttacaacctccttaccaaactattgatcacagtttctattgctaaaatcaccaacaaaacgcatgtcgccattcataattatggtttcacacctacaactaggctaataagtaaataagtagacaactagactcaggtttgaaaaaaccataaaagccatatagcgttttctcattgaaactgcgaacacgatcgtgtgaatgttgcagtttctagttttgatacaaacaaacaaaaacacaatttaatcttagattaaaaagaaaaaagagaacggagcccactagccactccttcaaacgtgtcttaccaactctcttctagaaacaaattaggcttcaccttcctcttccaacctctctctctctctctctctctttttctcaaaccatctctccataaagccctaatttcttcatcacaagaatcagaagaagaaagatggacctgcatctaattttcggtccaacttgcacaggaaagacgacgaccgcgatagctcttgcccagcagacagggcttccagtcctttcgcttgatcgggtccaatgctgtcctcaactatcaaccggaagcggacgaccaacagtggaagaactgaaaggaacgacgcgtctctaccttgatgatcggcctctggtggagggtatcatcgcagccaagcaagctcatcataggctgatcgaggaggtgtataatcatgaggccaacggcgggcttattcttgagggaggatccacctcgttgctcaactgcatggcgcgaaacagctattggagtgcagattttcgttggcatattattcgccacaagttacccgaccaagagaccttcatgaaagcggccaaggccagagttaagcagatgttgcaccccgctgcaggccattctattattcaagagttggtttatctttggaatgaacctcggctgaggcccattctgaaagagatcgatggatatcgatatgccatgttgtttgctagccagaaccagatcacggcagatatgctattgcagcttgacgcaaatatggaaggtaagttgattaatgggatcgctcaggagtatttcatccatgcgcgccaacaggaacagaaattcccccaagttaacgcagccgctttcgacggattcgaaggtcatccgttcggaatgtattagaaatcaccagtctctctctacaaatctatctctctctatttttctccagaataatgtgtgagtagttcccagataagggaattagggttcttatagggtttcgctcatgtgttgagcatataagaaacccttagtatgtatttgtatttgtaaaatacttctatcaataaaatttctaattcctaaaaccaaaatccagtgtttaaacgagtccatgctcaacaccgtgcactagggacaggattgaagactcccgcccatctcactagggacaggattgccaccccacagtggggcctagaaagactggagttgcagacattaaggatgaccagttcgtaaaggtcctgcggtgtctattgcttttcataggttaataagtgtttgctagactgtggtgaaaggcctatccgaagtaaggccggccggatccttcatctttggacaagggaataaagactccccacttgctactaagaacaatacctaagttgcccagacatgactgtacccattcagagacctaccacccattagggctatgacactaacactagcccctggaggttgaccatgctaggcagtgggggtctcacctatgacccactcagataggggtttaaaccagtgggtgggatctcagcctcatataggtgtttgtggtgagctttctcctagacaagagaaccctgaagaacagcaagaaccagctaatatgatatgtagacatagtgggttgctcaaattttgtgtttagtcatattagaattgacctcagtgaccactcagaaagtgcccaagcccatctataggggccaaagtgctattgactggtgtgtctgtgaattgttcctccctacagagttggtgctgatatatcctagcattctttggaaaacctagctagggactgtcaagtgtaagatacctcctgaattggagggaacactagctgccctgtaccttctggctagtaccttacaccctgaatgggttagggggtctattatttgctggaaatataccagtttcagtagggctgctgccttaggtcccacaaggtgtaacatgtgctcaatagttgcactaccacatgcacgtgaacttaatgatgttatagccacaacaccaaccttggtttgcagtttgacatccctctggaatgggtgtagtcatcttgctctggatctgcctgaatcattggggctgtatgcagcctgggcttaaagtgaagaatgggatgtcccagaaatattttgggtgagaagaatcctggagtagatggtgacctgactatccctgtcctatgggcacaatctatcatcagatattgcattcaaagggctatcatgggatcaagtcctaagtcaactgttgtttacctggcagacattcatctaggagttctcttttatgccaccccacagtgatccgccttttgcagtttatccactagggacaggattgccaccccacagtggggcctctatgcccgggacaagtgtaaaatatagagtataggggttatcatcacagagaagctattgctggagggcctctgttatttcctctccatgccactcccatttttaacctaccaactgaaatcccaagggagactccaccctgtaactagagtcctcagaggtgagccatcccatattaacaaatgggcattagggctaggatgccaagggatacctgaaatgggaagttgtggggctgagtcctcctgggaatcagagataatatgtaaacagtttgttgagagattgatgagagctgactttgagaggtggccatgctccctggtcctcaatagggaaggcactacacaagaaacctgggtttgatcaactgcactgtgtcctactcacacattgtgtgcctggaaaaatgttacttagtatttggagggcctccagaacccccctgggtgcaagactgggtgctagtgactgggtgaatgagtcttggacacagtggccttgtctaggttgtgtgaggtggctaggcatcatggcaatacctcataattgatgagtgaggaaacaagactaagtccttgactcctcttattacatgacctggtggatattatgtttaaactctgcaagctggaatgagtactgggtgcagatcccctgggattctggctacaaaggtgaatgatagctagtctgtttattagtagccaaaaaagtcagtgaggggtgagtgccctgggatgttgttaagttcacattgcacacttggagaccctctccatccagtaacataccagagaaaactgaccaagccctcatgggtgtatgggaacaacaaacctcctggctacttcaagggcacataacaccagcaaggagcctgtcataaccaccatctcaaacaatagaacttcctaagtgaagcaatgacttcaaatctacttgaaggcatggagtataagccatgttcctttcagaggggactgtacttctgtagattactttccctcattaaccagatctggccggccgcatgccttgctggtcgatcatgttggccactcttgtttatctatcattcctcgttggtccagtcacagttctaaaagtctatggtgttccttacattgtaagtttcatatatttcattattatatcattgctaatataatttgtttttgacataaagttttggaaaaatttcagatctttgtaatgtggttggacgctgtcacgtacttgcatcatcatggtcacgatgataagttgccttggtacagaggcaaggtaagtagatcaacattaatttataagaagcaacaatgattagtatttgattaatctaaattattgatgttttgtgtacaataataggaatggagttatttacgtggaggattaacaactattgatagagattacgggatcttcaacaacattcatcacgatattggaactcacgtgatccatcatcttttcccacaaatccctcactatcacttggttgatgccgtgagtgatctcgctctctctctagtttcatttgattaaaattaaagggtgattaattactaaattagtgatcttaattaatgatatgcgacagacgaaatcagctaaacatgtgttgggaagatactacagagaaccaaagacgtcaggagcaataccgatccacttggtggaaagtttggtggcaagtattaagaaagatcattacgtcagtgacactggtgatattgtcttctacgagacagatccagatctctacgtttatgcttctgacaaatccaaaatcaactaacctttcttcctagctctatttaggaataaaacagtcctttggtttttacttatttctggttgtttttaagttaaatgtactcgtgaaactttttttaattaaatgtatttacattacaaatcaagtttttgttcgttttctttatgtttttagttacaataaataaaggtcttaaaaactttttgttggtggggacaaaagaaaaagttcgactgagagagtcgacaaaatgc

SEQ ID NO: 145 - DNA, 13462 bp, Artificial Sequence
  T-strand Insert Region of pDAS000274
ttttttaatttaatttatttttttaatcggagaaaaaaattaagaaaccaaaaaacagttttaatcatggcctcatgttggggttgagttttatattctgataagaatcccatcttaaaaaccccgttaaacatgctcttaccatctgcttcgaaaatgatatgttattgacaattccaatttcatttttatgaaaataaaataatagtttattttataactgagggtggttgcaggagaataagccatcggacacaccaccagaaccatggccatgttgaaaacgacgagtcttgggttccggtaatctttccctctctcatattttttttcttttttttgaaattctttcattttaattttcttaggattctatgtatttattttaatcaatcctttttccagtttgaggctaggacgaccacttgtcagatttgtcgtttagctgtagtaaacaactgatttaaattgtttatagtactgtagttaactttaacaacggaccacttatattcgagccattggcataaaatgattcttctcgaaattcgtttacttttcttagtatttttcaattttggagtttacgtagaactaataaaaagaaaaacttataaacacaccacatgcaatgaataaattcgaatatataaccatactgttaaatattaatttacattttaatcttaattttgcattccagttgccagaaaaattatacaagaatttgtcccacagtacacggatgctcagatacactgtccctctccccatgctcgcttaccctctctatctggtaaatcctaattcctaatttttcttcctgattataattacaattttgaatttttagattttgagtattaactaaatataaattaaatttgtttggggatgactacagtggtacagaagtcctggtaaagaagggtcacattataacccatacagtagtttatttgccccaagcgagagaaagcttattgcaacttcaactactggtaccgccttttgcagtttatctctatgcccgggacaagtggagtccatgctcaacaccgtgcaggatgaggatgaccaccgcggtagcgacttcgtgggcgaggaaagcctttcgtccaaggtggtccctcctcgcaatcttgttggatggtgaatattataaaagcctgcccttctcgcgggtgtttaaacgtcgacctgcaggtcaacggatcaggatattcttgtttaagatgttgaactctatggaggtttgtatgaactgatgatctaggaccggataagttcccttcttcatagcgaacttattcaaagaatgttttgtgtatcattcttgttacattgttattaatgaaaaaatattattggtcattggactgaacacgagtgttaaatatggaccaggccccaaataagatccattgatatatgaattaaataacaagaataaatcgagtcaccaaaccacttgccttttttaacgagacttgttcaccaacttgatacaaaagtcattatcctatgcaaatcaataatcatacaaaaatatccaataacactaaaaaattaaaagaaatggataatttcacaatatgttatacgataaagaagttacttttccaagaaattcactgattttataagcccacttgcattagataaatggcaaaaaaaaacaaaaaggaaaagaaataaagcacgaagaattctagaaaatacgaaatacgcttcaatgcagtgggacccacggttcaattattgccaattttcagctccaccgtatatttaaaaaataaaacgataatgctaaaaaaatataaatcgtaacgatcgttaaatctcaacggctggatcttatgacgaccgttagaaattgtggttgtcgacgagtcagtaataaacggcgtcaaagtggttgcagccggcacacacgagtcgtgtttatcaactcaaagcacaaatacttttcctcaacctaaaaataaggcaattagccaaaaacaactttgcgtgtaaacaacgctcaatacacgtgtcattttattattagctattgcttcaccgccttagctttctcgtgacctagtcgtcctcgtcttttcttcttcttcttctataaaacaatacccaaagagctcttcttcttcacaattcagatttcaatttctcaaaatcttaaaaactttctctcaattctctctaccgtgatcaaggtaaatttctgtgttccttattctctcaaaatcttcgattttgttttcgttcgatcccaatttcgtatatgttctttggtttagattctgttaatcttagatcgaagacgattttctgggtttgatcgttagatatcatcttaattctcgattagggtttcatagatatcatccgatttgttcaaataatttgagttttgtcgaataattactcttcgatttgtgatttctatctagatctggtgttagtttctagtttgtgcgatcgaatttgtcgattaatctgagtttttctgattaacagatggcttcatctgagaacgttatcactgagttcatgaggttcaaggtgaggatggaaggtactgttaacggacatgagttcgagatcgagggtgagggtgaaggtagaccttacgagggacataacaccgttaagcttaaggttacaaagggtggacctcttcctttcgcttgggatatcctttctcctcaattccaatacggaagcaaggtaagtttgtggattcttcgtccatgtgatctttgagtttctttagagcttgtgagggattagtaagtaacaatgcttgagttttttgctgctgggcttcgaaaagtttgtcacttgttggtttgatccacaaggtcttcttctccatagctactagacatgttttagcttaagattcaagtttatatatgccttgtggattaatcattgcctgattcttccgtgtcatctctgagtttatttagagcttggaagtggtgtagtaataactaacaatactcttgataagttgtagcaatgctcttgattagtggatgtaatatgatgttgataagatatatgaggcacagaaccaaaagtggtgcttccactagacccgtttttagcctaaggttcaagtttataccttgtagatgtttctgtattgtctgattcttccctgtgatatttgaatttcttagagctttggaagtgatataggaacaatgctcttgtgtgtttgtctctatgaagattatcgctgtcgtgtttcatccgagtgtgcgggattttttgctgctgggtttagcctttcttcaaaaagttattacttgttagttttattgttttggtcttgataagagatgttaggacagacatggtgcttcttgtctatagccactagacctattttagcataaggttaacgaaattctctctacataccttgtggatttgtttacattgcctgatctttcctgtgatcgctgtcatgtttctttggaatgattgatgtttataaatggaaaaatctttgtgcagaagactcccgcccatctctctatgcccgggacaagtgccaccccacagtggggcaggatgaggatgaccaccatggggtcgcagcgtgtgcgtgtccgtcgtacgttctggccggccgggccttgggcgcgcgatcagaagcgttgcgttggcgtgtgtgtgcttctggtttgctttaattttaccaagtttgtttcaaggtggatcgcgtggtcaaggcccgtgtgctttaaagacccaccggcactggcagtgagtgttgctgcttgtgtaggctttggtacgtatgggctttatttgcttctggatgttgtgtactacttgggtttgttgaattattatgagcagttgcgtattgtaattcagctgggctacctggacattgttatgtattaataaatgctttgctttcttctaaagatctttaagtgctgtttaaacaaccgacaaccactttgcggacttcctttcaagagaattcaataaggttaattcctaattgaaatccgaagataagattcccacacacttgtggctgatatcaaaaggctactgcctatttaaacacatctctggagactgagaaaatcagacctccaagcatgaagaagcctgagcttactgctacttctgttgagaagttcctcatcgagaagttcgattctgtgtctgatcttatgcagctctctgagggtgaggaatcaagagctttctctttcgatgttggtggaagaggatacgttctcagagttaactcttgcgctgacggattctacaaggatagatacgtgtacagacacttcgcttcagctgctctccctatccctgaagttcttgatatcggagagttctctgagtctcttacctactgtatctcaagaagggctcagggtgttactcttcaagatcttcctgagactgagcttcctgctgttcttcaacctgttgctgaggctatggatgctatcgctgctgctgatctttctcaaacttctggattcggacctttcggtcctcagggaatcggacagtacactacttggagagatttcatctgcgctatcgctgatcctcatgtttaccattggcagaccgttatggatgataccgtttctgcttctgttgctcaagctcttgatgagcttatgctttgggctgaggattgtcctgaggttagacatcttgttcacgctgatttcggatctaacaacgttctcaccgataacggaagaatcaccgctgttatcgattggtctgaggctatgttcggagattctcaatacgaggtggccaacatattcttttggaggccttggcttgcttgtatggaacaacagactagatacttcgagagaaggcatcctgagcttgctggatctcctagacttagagcttacatgcttaggatcggacttgatcagctttaccagtctctcgttgatggaaacttcgatgatgctgcttgggctcagggaagatgtgatgctatcgttagatctggtgctggaactgttggaagaactcaaatcgctagaagatctgctgctgtttggactgatggatgtgttgaagttctcgctgattctggaaacagaaggccttctactagacctagagccaagaagtgaagatcggcggcaatagcttcttagcgccatcccgggttgatcctatctgtgttgaaatagttgcggtgggcaaggctctctttcagaaagacaggcggccaaaggaacccaaggtgaggtgggctatggctctcagttccttgtggaagcgcttggtctaaggtgcagaggtgttagcgggatgaagcaaaagtgtccgattgtaacaagatatgttgatcctacgtaaggatattaaagtatgtattcatcactaatataatcagtgtattccaatatgtactacgatttccaatgtctttattgtcgccgtatgtaatcggcgtcacaaaataatccccggtgactttcttttaatccaggatgaaataatatgttattataatttttgcgatttggtccgttataggaattgaagtgtgcttgcggtcgccaccactcccatttcataattttacatgtatttgaaaaataaaaatttatggtattcaatttaaacacgtatacttgtaaagaatgatatcttgaaagaaatatagtttaaatatttattgataaaataacaagtcaggtattatagtccaagcaaaaacataaatttattgatgcaagtttaaattcagaaatatttcaataactgattatatcagctggtacattgccgtagatgaaagactgagtgcgatattatggtgtaatacatagtttaaacgggcccaagactcccgcccatctctctatgcccgggacaagtgccaccccacagtggggcaggatgaggatgaccagtcagttttacttcccttaattttctatgtactttcataattacttatgttattttcttcatgagttttaatgcaaattactatatggactctagtgaaaacgttcagaatcctataaacatgactactgagacgaacttgagagtagttttgatcatacacacgtttcatgtggtacttgagagttactaatttttgtcatcttcgtataagtagtaaaagatactacaagaatagtttagtagaaaatactagcggtaggtgaagatttgtcgctatgtactattattgtctagtaacttgagtaacaatttcgtggtctaaatatcaaataaaaatggatgagtggttcaccaaatctaggcatcaaaactattaatgtcattgtctagatcttaggtgacaccacatttcgaatatttattggtaattgagatgttaaagtaccaatatttgacttaataaactaaaagattttggctttatcaaatgtagacattgatgacatatcgttgtcattatcttgagtatatacaagtcgatcaattaggtgaaagtttagtgtctcgtggttggtaaacgattaatacagtagtatattttatccaaagacaaaatccaaatcatttcaccagtatgaatagtattattttatcttaaaagctaaaatcttaaaaaccaaggtagcacccacgttgagctagacgatcaaatcgatttctgctttgtccaatttaccaagctatttaaagccaaataattgaaatataggtaggtcgttatattaggctaagatttatctcaaatgcttaactaaaggaataacaagggattctagttgtgtggttttataagattggtccaatttcacttaagtttgtttattgtagaattttatatgtgaataatttgaattccaattgaaaagatattatagtaaaagaaaaaatagtgcgaacaaaaaactttaatcccataaaaagaaaaagaaaaatgaaaagttcttctaacatccatattttgcatcatatcataaagataagaaagatacatatcatagacgtacagataaacaaacatatcatcatttgtgaaatacatagtacaataatttgcttttaaatagagtttaagtcacacacactgacacacacgataaaacgataatgtctgcaaaaacactttaatcccattgcctagaggacagcttctccactttgtctttaaggttggttttgccgtgttgtttttatctttatataatgatctattttttggattatgaaatgaattcacacattttaattatttaagaagatccatatacaggtttataacagtactaagtgatgattattttttgtttttgcatagtttagtttattgggtaaacattcattacgtgtctctttatacgaatcacccatccaaaatttcaagtagtcttttagttcatttattatttcataactatttgacttattgatttgacaagaaacaacaaaagtgttgacttattgatagattgtgggatcataaaagtaattaagcgtcaaccacgacccacaacaacaaagcacatgttatacattaatatctcgtttacttaattacagttttcagaatgccgtttcatgtcttgtcactggcgatgttattatcatgttggacaatattcgactgttgtcgtttttacattttcgtattgactaaaactaaaaaaacaaaactctgtttcaggttgggcctaggatccacattgtacacacatttgcttaagtctatggaggcgcaaggttttaagtctgtggttgctgttataggccttccaaacgatccatctgttaggttgcatgaggctttgggatacacagcccggggtacattgcgcgcagctggatacaagcatggtggatggcatgatgttggtttttggcaaagggattttgagttgccagctcctccaaggccagttaggccagttacccagatctaatatcaaaatctatttagaaatacacaatattttgttgcaggcttgctggagaatcgatctgctatcataaaaattacaaaaaaattttatttgcctcaattattttaggattggtattaaggacgcttaaattatttgtcgggtcactacgcatcattgtgattgagaagatcagcgatacgaaatattcgtagtactatcgataatttatttgaaaattcataagaaaagcaaacgttacatgaattgatgaaacaatacaaagacagataaagccacgcacatttaggatattggccgagattactgaatattgagtaagatcacggaatttctgacaggagcatgtcttcaattcagcccaaatggcagttgaaatactcaaaccgccccatatgcaggagcggatcattcattgtttgtttggttgcctttgccaacatgggagtccaaggttgtttaaacatttaaataccctgccaagcttgaggtagcctccaatttgacggtgccgccagcgacgccgtctggaactgtcctttttgaggaccactccgtttgtggagatcatgagagtccatgctcaacaccgtgcactagggacaggattgaagactcccgcccatctcactagggacaggattgccaccccacagtggggcctagaaagactggagttgcagagtttgtgtcttctagattaatcctccaaacttttgattaaccaaaaaaattatcaaactaacatgttctccttttttctttagaaattctaacgaatttatctttatactgatttgaatatacttaatttggtcatttggatgccctttacaacctccttaccaaactattgatcacagtttctattgctaaaatcaccaacaaaacgcatgtcgccattcataattatggtttcacacctacaactaggctaataagtaaataagtagacaactagactcaggtttgaaaaaaccataaaagccatatagcgttttctcattgaaactgcgaacacgatcgtgtgaatgttgcagtttctagttttgatacaaacaaacaaaaacacaatttaatcttagattaaaaagaaaaaagagaacggagcccactagccactccttcaaacgtgtcttaccaactctcttctagaaacaaattaggcttcaccttcctcttccaacctctctctctctctctctctctttttctcaaaccatctctccataaagccctaatttcttcatcacaagaatcagaagaagaaagatggacctgcatctaattttcggtccaacttgcacaggaaagacgacgaccgcgatagctcttgcccagcagacagggcttccagtcctttcgcttgatcgggtccaatgctgtcctcaactatcaaccggaagcggacgaccaacagtggaagaactgaaaggaacgacgcgtctctaccttgatgatcggcctctggtggagggtatcatcgcagccaagcaagctcatcataggctgatcgaggaggtgtataatcatgaggccaacggcgggcttattcttgagggaggatccacctcgttgctcaactgcatggcgcgaaacagctattggagtgcagattttcgttggcatattattcgccacaagttacccgaccaagagaccttcatgaaagcggccaaggccagagttaagcagatgttgcaccccgctgcaggccattctattattcaagagttggtttatctttggaatgaacctcggctgaggcccattctgaaagagatcgatggatatcgatatgccatgttgtttgctagccagaaccagatcacggcagatatgctattgcagcttgacgcaaatatggaaggtaagttgattaatgggatcgctcaggagtatttcatccatgcgcgccaacaggaacagaaattcccccaagttaacgcagccgctttcgacggattcgaaggtcatccgttcggaatgtattagaaatcaccagtctctctctacaaatctatctctctctatttttctccagaataatgtgtgagtagttcccagataagggaattagggttcttatagggtttcgctcatgtgttgagcatataagaaacccttagtatgtatttgtatttgtaaaatacttctatcaataaaatttctaattcctaaaaccaaaatccagtgtttaaacgagtccatgctcaacaccgtgcactagggacaggattgaagactcccgcccatctcactagggacaggattgccaccccacagtggggcctagaaagactggagttgcagacattaaggatgaccagttcgtaaaggtcctgcggtgtctattgcttttcataggttaataagtgtttgctagactgtggtgaaaggcctatccgaagtaaggccggccggatccttcatctttggacaagggaataaagactccccacttgctactaagaacaatacctaagttgcccagacatgactgtacccattcagagacctaccacccattagggctatgacactaacactagcccctggaggttgaccatgctaggcagtgggggtctcacctatgacccactcagataggggtttaaaccagtgggtgggatctcagcctcatataggtgtttgtggtgagctttctcctagacaagagaaccctgaagaacagcaagaaccagctaatatgatatgtagacatagtgggttgctcaaattttgtgtttagtcatattagaattgacctcagtgaccactcagaaagtgcccaagcccatctataggggccaaagtgctattgactggtgtgtctgtgaattgttcctccctacagagttggtgctgatatatcctagcattctttggaaaacctagctagggactgtcaagtgtaagatacctcctgaattggagggaacactagctgccctgtaccttctggctagtaccttacaccctgaatgggttagggggtctattatttgctggaaatataccagtttcagtagggctgctgccttaggtcccacaaggtgtaacatgtgctcaatagttgcactaccacatgcacgtgaacttaatgatgttatagccacaacaccaaccttggtttgcagtttgacatccctctggaatgggtgtagtcatcttgctctggatctgcctgaatcattggggctgtatgcagcctgggcttaaagtgaagaatgggatgtcccagaaatattttgggtgagaagaatcctggagtagatggtgacctgactatccctgtcctatgggcacaatctatcatcagatattgcattcaaagggctatcatgggatcaagtcctaagtcaactgttgtttacctggcagacattcatctaggagttctcttttatgccaccccacagtgatccgccttttgcagtttatccactagggacaggattgccaccccacagtggggcctctatgcccgggacaagtgtaaaatatagagtataggggttatcatcacagagaagctattgctggagggcctctgttatttcctctccatgccactcccatttttaacctaccaactgaaatcccaagggagactccaccctgtaactagagtcctcagaggtgagccatcccatattaacaaatgggcattagggctaggatgccaagggatacctgaaatgggaagttgtggggctgagtcctcctgggaatcagagataatatgtaaacagtttgttgagagattgatgagagctgactttgagaggtggccatgctccctggtcctcaatagggaaggcactacacaagaaacctgggtttgatcaactgcactgtgtcctactcacacattgtgtgcctggaaaaatgttacttagtatttggagggcctccagaacccccctgggtgcaagactgggtgctagtgactgggtgaatgagtcttggacacagtggccttgtctaggttgtgtgaggtggctaggcatcatggcaatacctcataattgatgagtgaggaaacaagactaagtccttgactcctcttattacatgacctggtggatattatgtttaaactctgcaagctggaatgagtactgggtgcagatcccctgggattctggctacaaaggtgaatgatagctagtctgtttattagtagccaaaaaagtcagtgaggggtgagtgccctgggatgttgttaagttcacattgcacacttggagaccctctccatccagtaacataccagagaaaactgaccaagccctcatgggtgtatgggaacaacaaacctcctggctacttcaagggcacataacaccagcaaggagcctgtcataaccaccatctcaaacaatagaacttcctaagtgaagcaatgacttcaaatctacttgaaggcatggagtataagccatgttcctttcagaggggactgtacttctgtagattactttccctcattaaccagatctggccggccgcatgcggtcgatcgtgttggccactcttgtttatctatcattcctcgttggtccagtcacagttctaaaagtctatggtgttccttacattgtaagtttcatatatttctttattatatcattgctaatataatttgtttttgacataaaagttttggaaaaatttcagatctttgtaatgtggttggacgctgtcacgtacttgcatcatcatggtcacgatgataagctgccttggtacagaggcaaggtaagtagatcaacattatttataagaagcaataatgattagtagttgaataatctgaatttttgatgtttttgtacaataataggaatggagttatttacgtggaggattaacaactgttgatagagattacgggatcttcaacaacattcatcacgatattggaactcacgtgatccatcatcttttcccacaaatccctcactatcacttggtcgatgccgtgagtgatctcgctctctctctagtttcatttgattatattaaagggtgattaattactaaattagtgatcttaattaatgacatgcgacagacgaaagcagctaaacatgtgttgggaagatactacagagaaccaaagacgtcaggagcaataccgatccacttagtggaaagtttggtggcaagtattaagaaagatcattacgtcagtgacactggtgatattgtcttctacgagacagatccagatctctacgtttatgcttctgacaaatccaaaatcaattaatctttcttcctagctctatttaggaataaaacactcctttggttttacttatttctggttgtttttaagttaaaaatgtactcgtgaaacttttttttattaaatgtatttacattacaaatcgtaaaagtttttgttcgttttctctatgtttttagttacaaacttacaatcaaaaaggtcttaaaaactttttgatggtgggacggacaaaagaaaaagttcgactgagagtcgacaa

SEQ ID NO: 146 - DNA, 13462 bp, Artificial Sequence
  T-strand Insert Region of pDAS000275
tatatatatttgttttaatggcttattttattgttaaatggatacatcagcttgaaatatctacgaacatgcatcattttcctagatacatttgtttgttgctcaaaaaatgaataacgtagttaaacgagtgagattcttagcatctgcctcgaaaacgatatgttattgacaattccaatttcatttttatgaaaataaaataatagtttattttataattgggggtggttgcaggagaataagccatcggacacaccaccagaaccatggccatgttgaaaacgacgagtcttgggttccggtaatccccctctcattatttttttttctttttttgaaactctttcattttaattttcttagaattctatgtatttattttaatcaatcctttttccagtgtgaggcttggacgaccacttgtcagatttgtcgtttagctgtagtaaacaactgatttaaattgtttatggtactgtagttaactttaacaacgggccacttatattcgagccattggcataaaatgattcttctcgaaattcgtttacttttcttagtatttttcagttttgtagtttacgtagaactaataaaaagaaaaaaacttataaacacaccacatgcaatgaataaattcgaatatataaccatactgttaaatattaattaacattttaatcttaattttgcattccagttgccagaaaaattatacaagaatttgtcccacagtacacggatgctcagatacactgtccctctccccatgctcgcttaccctctctatctggtaaatcctaattcctcatttttcttcctgattataattacaattttgaatttttagattttgagtattaactaaatataaattaaatttgtttggggatgactacagtggtacagaagtcctggtaaagaagggtcacattataacccatacagtagtttatttgccccaagcgagagaaagcttattgcaacttcaactactggtaccgccttttgcagtttatctctatgcccgggacaagtggagtccatgctcaacaccgtgcaggatgaggatgaccaccgcggtagcgacttcgtgggcgaggaaagcctttcgtccaaggtggtccctcctcgcaatcttgttggatggtgaatattataaaagcctgcccttctcgcgggtgtttaaacgtcgacctgcaggtcaacggatcaggatattcttgtttaagatgttgaactctatggaggtttgtatgaactgatgatctaggaccggataagttcccttcttcatagcgaacttattcaaagaatgttttgtgtatcattcttgttacattgttattaatgaaaaaatattattggtcattggactgaacacgagtgttaaatatggaccaggccccaaataagatccattgatatatgaattaaataacaagaataaatcgagtcaccaaaccacttgccttttttaacgagacttgttcaccaacttgatacaaaagtcattatcctatgcaaatcaataatcatacaaaaatatccaataacactaaaaaattaaaagaaatggataatttcacaatatgttatacgataaagaagttacttttccaagaaattcactgattttataagcccacttgcattagataaatggcaaaaaaaaacaaaaaggaaaagaaataaagcacgaagaattctagaaaatacgaaatacgcttcaatgcagtgggacccacggttcaattattgccaattttcagctccaccgtatatttaaaaaataaaacgataatgctaaaaaaatataaatcgtaacgatcgttaaatctcaacggctggatcttatgacgaccgttagaaattgtggttgtcgacgagtcagtaataaacggcgtcaaagtggttgcagccggcacacacgagtcgtgtttatcaactcaaagcacaaatacttttcctcaacctaaaaataaggcaattagccaaaaacaactttgcgtgtaaacaacgctcaatacacgtgtcattttattattagctattgcttcaccgccttagctttctcgtgacctagtcgtcctcgtcttttcttcttcttcttctataaaacaatacccaaagagctcttcttcttcacaattcagatttcaatttctcaaaatcttaaaaactttctctcaattctctctaccgtgatcaaggtaaatttctgtgttccttattctctcaaaatcttcgattttgttttcgttcgatcccaatttcgtatatgttctttggtttagattctgttaatcttagatcgaagacgattttctgggtttgatcgttagatatcatcttaattctcgattagggtttcatagatatcatccgatttgttcaaataatttgagttttgtcgaataattactcttcgatttgtgatttctatctagatctggtgttagtttctagtttgtgcgatcgaatttgtcgattaatctgagtttttctgattaacagatggcttcatctgagaacgttatcactgagttcatgaggttcaaggtgaggatggaaggtactgttaacggacatgagttcgagatcgagggtgagggtgaaggtagaccttacgagggacataacaccgttaagcttaaggttacaaagggtggacctcttcctttcgcttgggatatcctttctcctcaattccaatacggaagcaaggtaagtttgtggattcttcgtccatgtgatctttgagtttctttagagcttgtgagggattagtaagtaacaatgcttgagttttttgctgctgggcttcgaaaagtttgtcacttgttggtttgatccacaaggtcttcttctccatagctactagacatgttttagcttaagattcaagtttatatatgccttgtggattaatcattgcctgattcttccgtgtcatctctgagtttatttagagcttggaagtggtgtagtaataactaacaatactcttgataagttgtagcaatgctcttgattagtggatgtaatatgatgttgataagatatatgaggcacagaaccaaaagtggtgcttccactagacccgtttttagcctaaggttcaagtttataccttgtagatgtttctgtattgtctgattcttccctgtgatatttgaatttcttagagctttggaagtgatataggaacaatgctcttgtgtgtttgtctctatgaagattatcgctgtcgtgtttcatccgagtgtgcgggattttttgctgctgggtttagcctttcttcaaaaagttattacttgttagttttattgttttggtcttgataagagatgttaggacagacatggtgcttcttgtctatagccactagacctattttagcataaggttaacgaaattctctctacataccttgtggatttgtttacattgcctgatctttcctgtgatcgctgtcatgtttctttggaatgattgatgtttataaatggaaaaatctttgtgcagaagactcccgcccatctctctatgcccgggacaagtgccaccccacagtggggcaggatgaggatgaccaccatggggtcgcagcgtgtgcgtgtccgtcgtacgttctggccggccgggccttgggcgcgcgatcagaagcgttgcgttggcgtgtgtgtgcttctggtttgctttaattttaccaagtttgtttcaaggtggatcgcgtggtcaaggcccgtgtgctttaaagacccaccggcactggcagtgagtgttgctgcttgtgtaggctttggtacgtatgggctttatttgcttctggatgttgtgtactacttgggtttgttgaattattatgagcagttgcgtattgtaattcagctgggctacctggacattgttatgtattaataaatgctttgctttcttctaaagatctttaagtgctgtttaaacaaccgacaaccactttgcggacttcctttcaagagaattcaataaggttaattcctaattgaaatccgaagataagattcccacacacttgtggctgatatcaaaaggctactgcctatttaaacacatctctggagactgagaaaatcagacctccaagcatgaagaagcctgagcttactgctacttctgttgagaagttcctcatcgagaagttcgattctgtgtctgatcttatgcagctctctgagggtgaggaatcaagagctttctctttcgatgttggtggaagaggatacgttctcagagttaactcttgcgctgacggattctacaaggatagatacgtgtacagacacttcgcttcagctgctctccctatccctgaagttcttgatatcggagagttctctgagtctcttacctactgtatctcaagaagggctcagggtgttactcttcaagatcttcctgagactgagcttcctgctgttcttcaacctgttgctgaggctatggatgctatcgctgctgctgatctttctcaaacttctggattcggacctttcggtcctcagggaatcggacagtacactacttggagagatttcatctgcgctatcgctgatcctcatgtttaccattggcagaccgttatggatgataccgtttctgcttctgttgctcaagctcttgatgagcttatgctttgggctgaggattgtcctgaggttagacatcttgttcacgctgatttcggatctaacaacgttctcaccgataacggaagaatcaccgctgttatcgattggtctgaggctatgttcggagattctcaatacgaggtggccaacatattcttttggaggccttggcttgcttgtatggaacaacagactagatacttcgagagaaggcatcctgagcttgctggatctcctagacttagagcttacatgcttaggatcggacttgatcagctttaccagtctctcgttgatggaaacttcgatgatgctgcttgggctcagggaagatgtgatgctatcgttagatctggtgctggaactgttggaagaactcaaatcgctagaagatctgctgctgtttggactgatggatgtgttgaagttctcgctgattctggaaacagaaggccttctactagacctagagccaagaagtgaagatcggcggcaatagcttcttagcgccatcccgggttgatcctatctgtgttgaaatagttgcggtgggcaaggctctctttcagaaagacaggcggccaaaggaacccaaggtgaggtgggctatggctctcagttccttgtggaagcgcttggtctaaggtgcagaggtgttagcgggatgaagcaaaagtgtccgattgtaacaagatatgttgatcctacgtaaggatattaaagtatgtattcatcactaatataatcagtgtattccaatatgtactacgatttccaatgtctttattgtcgccgtatgtaatcggcgtcacaaaataatccccggtgactttcttttaatccaggatgaaataatatgttattataatttttgcgatttggtccgttataggaattgaagtgtgcttgcggtcgccaccactcccatttcataattttacatgtatttgaaaaataaaaatttatggtattcaatttaaacacgtatacttgtaaagaatgatatcttgaaagaaatatagtttaaatatttattgataaaataacaagtcaggtattatagtccaagcaaaaacataaatttattgatgcaagtttaaattcagaaatatttcaataactgattatatcagctggtacattgccgtagatgaaagactgagtgcgatattatggtgtaatacatagtttaaacgggcccaagactcccgcccatctctctatgcccgggacaagtgccaccccacagtggggcaggatgaggatgaccagtcagttttacttcccttaattttctatgtactttcataattacttatgttattttcttcatgagttttaatgcaaattactatatggactctagtgaaaacgttcagaatcctataaacatgactactgagacgaacttgagagtagttttgatcatacacacgtttcatgtggtacttgagagttactaatttttgtcatcttcgtataagtagtaaaagatactacaagaatagtttagtagaaaatactagcggtaggtgaagatttgtcgctatgtactattattgtctagtaacttgagtaacaatttcgtggtctaaatatcaaataaaaatggatgagtggttcaccaaatctaggcatcaaaactattaatgtcattgtctagatcttaggtgacaccacatttcgaatatttattggtaattgagatgttaaagtaccaatatttgacttaataaactaaaagattttggctttatcaaatgtagacattgatgacatatcgttgtcattatcttgagtatatacaagtcgatcaattaggtgaaagtttagtgtctcgtggttggtaaacgattaatacagtagtatattttatccaaagacaaaatccaaatcatttcaccagtatgaatagtattattttatcttaaaagctaaaatcttaaaaaccaaggtagcacccacgttgagctagacgatcaaatcgatttctgctttgtccaatttaccaagctatttaaagccaaataattgaaatataggtaggtcgttatattaggctaagatttatctcaaatgcttaactaaaggaataacaagggattctagttgtgtggttttataagattggtccaatttcacttaagtttgtttattgtagaattttatatgtgaataatttgaattccaattgaaaagatattatagtaaaagaaaaaatagtgcgaacaaaaaactttaatcccataaaaagaaaaagaaaaatgaaaagttcttctaacatccatattttgcatcatatcataaagataagaaagatacatatcatagacgtacagataaacaaacatatcatcatttgtgaaatacatagtacaataatttgcttttaaatagagtttaagtcacacacactgacacacacgataaaacgataatgtctgcaaaaacactttaatcccattgcctagaggacagcttctccactttgtctttaaggttggttttgccgtgttgtttttatctttatataatgatctattttttggattatgaaatgaattcacacattttaattatttaagaagatccatatacaggtttataacagtactaagtgatgattattttttgtttttgcatagtttagtttattgggtaaacattcattacgtgtctctttatacgaatcacccatccaaaatttcaagtagtcttttagttcatttattatttcataactatttgacttattgatttgacaagaaacaacaaaagtgttgacttattgatagattgtgggatcataaaagtaattaagcgtcaaccacgacccacaacaacaaagcacatgttatacattaatatctcgtttacttaattacagttttcagaatgccgtttcatgtcttgtcactggcgatgttattatcatgttggacaatattcgactgttgtcgtttttacattttcgtattgactaaaactaaaaaaacaaaactctgtttcaggttgggcctaggatccacattgtacacacatttgcttaagtctatggaggcgcaaggttttaagtctgtggttgctgttataggccttccaaacgatccatctgttaggttgcatgaggctttgggatacacagcccggggtacattgcgcgcagctggatacaagcatggtggatggcatgatgttggtttttggcaaagggattttgagttgccagctcctccaaggccagttaggccagttacccagatctaatatcaaaatctatttagaaatacacaatattttgttgcaggcttgctggagaatcgatctgctatcataaaaattacaaaaaaattttatttgcctcaattattttaggattggtattaaggacgcttaaattatttgtcgggtcactacgcatcattgtgattgagaagatcagcgatacgaaatattcgtagtactatcgataatttatttgaaaattcataagaaaagcaaacgttacatgaattgatgaaacaatacaaagacagataaagccacgcacatttaggatattggccgagattactgaatattgagtaagatcacggaatttctgacaggagcatgtcttcaattcagcccaaatggcagttgaaatactcaaaccgccccatatgcaggagcggatcattcattgtttgtttggttgcctttgccaacatgggagtccaaggttgtttaaacatttaaataccctgccaagcttgaggtagcctccaatttgacggtgccgccagcgacgccgtctggaactgtcctttttgaggaccactccgtttgtggagatcatgagagtccatgctcaacaccgtgcactagggacaggattgaagactcccgcccatctcactagggacaggattgccaccccacagtggggcctagaaagactggagttgcagagtttgtgtcttctagattaatcctccaaacttttgattaaccaaaaaaattatcaaactaacatgttctccttttttctttagaaattctaacgaatttatctttatactgatttgaatatacttaatttggtcatttggatgccctttacaacctccttaccaaactattgatcacagtttctattgctaaaatcaccaacaaaacgcatgtcgccattcataattatggtttcacacctacaactaggctaataagtaaataagtagacaactagactcaggtttgaaaaaaccataaaagccatatagcgttttctcattgaaactgcgaacacgatcgtgtgaatgttgcagtttctagttttgatacaaacaaacaaaaacacaatttaatcttagattaaaaagaaaaaagagaacggagcccactagccactccttcaaacgtgtcttaccaactctcttctagaaacaaattaggcttcaccttcctcttccaacctctctctctctctctctctctttttctcaaaccatctctccataaagccctaatttcttcatcacaagaatcagaagaagaaagatggacctgcatctaattttcggtccaacttgcacaggaaagacgacgaccgcgatagctcttgcccagcagacagggcttccagtcctttcgcttgatcgggtccaatgctgtcctcaactatcaaccggaagcggacgaccaacagtggaagaactgaaaggaacgacgcgtctctaccttgatgatcggcctctggtggagggtatcatcgcagccaagcaagctcatcataggctgatcgaggaggtgtataatcatgaggccaacggcgggcttattcttgagggaggatccacctcgttgctcaactgcatggcgcgaaacagctattggagtgcagattttcgttggcatattattcgccacaagttacccgaccaagagaccttcatgaaagcggccaaggccagagttaagcagatgttgcaccccgctgcaggccattctattattcaagagttggtttatctttggaatgaacctcggctgaggcccattctgaaagagatcgatggatatcgatatgccatgttgtttgctagccagaaccagatcacggcagatatgctattgcagcttgacgcaaatatggaaggtaagttgattaatgggatcgctcaggagtatttcatccatgcgcgccaacaggaacagaaattcccccaagttaacgcagccgctttcgacggattcgaaggtcatccgttcggaatgtattagaaatcaccagtctctctctacaaatctatctctctctatttttctccagaataatgtgtgagtagttcccagataagggaattagggttcttatagggtttcgctcatgtgttgagcatataagaaacccttagtatgtatttgtatttgtaaaatacttctatcaataaaatttctaattcctaaaaccaaaatccagtgtttaaacgagtccatgctcaacaccgtgcactagggacaggattgaagactcccgcccatctcactagggacaggattgccaccccacagtggggcctagaaagactggagttgcagacattaaggatgaccagttcgtaaaggtcctgcggtgtctattgcttttcataggttaataagtgtttgctagactgtggtgaaaggcctatccgaagtaaggccggccggatccttcatctttggacaagggaataaagactccccacttgctactaagaacaatacctaagttgcccagacatgactgtacccattcagagacctaccacccattagggctatgacactaacactagcccctggaggttgaccatgctaggcagtgggggtctcacctatgacccactcagataggggtttaaaccagtgggtgggatctcagcctcatataggtgtttgtggtgagctttctcctagacaagagaaccctgaagaacagcaagaaccagctaatatgatatgtagacatagtgggttgctcaaattttgtgtttagtcatattagaattgacctcagtgaccactcagaaagtgcccaagcccatctataggggccaaagtgctattgactggtgtgtctgtgaattgttcctccctacagagttggtgctgatatatcctagcattctttggaaaacctagctagggactgtcaagtgtaagatacctcctgaattggagggaacactagctgccctgtaccttctggctagtaccttacaccctgaatgggttagggggtctattatttgctggaaatataccagtttcagtagggctgctgccttaggtcccacaaggtgtaacatgtgctcaatagttgcactaccacatgcacgtgaacttaatgatgttatagccacaacaccaaccttggtttgcagtttgacatccctctggaatgggtgtagtcatcttgctctggatctgcctgaatcattggggctgtatgcagcctgggcttaaagtgaagaatgggatgtcccagaaatattttgggtgagaagaatcctggagtagatggtgacctgactatccctgtcctatgggcacaatctatcatcagatattgcattcaaagggctatcatgggatcaagtcctaagtcaactgttgtttacctggcagacattcatctaggagttctcttttatgccaccccacagtgatccgccttttgcagtttatccactagggacaggattgccaccccacagtggggcctctatgcccgggacaagtgtaaaatatagagtataggggttatcatcacagagaagctattgctggagggcctctgttatttcctctccatgccactcccatttttaacctaccaactgaaatcccaagggagactccaccctgtaactagagtcctcagaggtgagccatcccatattaacaaatgggcattagggctaggatgccaagggatacctgaaatgggaagttgtggggctgagtcctcctgggaatcagagataatatgtaaacagtttgttgagagattgatgagagctgactttgagaggtggccatgctccctggtcctcaatagggaaggcactacacaagaaacctgggtttgatcaactgcactgtgtcctactcacacattgtgtgcctggaaaaatgttacttagtatttggagggcctccagaacccccctgggtgcaagactgggtgctagtgactgggtgaatgagtcttggacacagtggccttgtctaggttgtgtgaggtggctaggcatcatggcaatacctcataattgatgagtgaggaaacaagactaagtccttgactcctcttattacatgacctggtggatattatgtttaaactctgcaagctggaatgagtactgggtgcagatcccctgggattctggctacaaaggtgaatgatagctagtctgtttattagtagccaaaaaagtcagtgaggggtgagtgccctgggatgttgttaagttcacattgcacacttggagaccctctccatccagtaacataccagagaaaactgaccaagccctcatgggtgtatgggaacaacaaacctcctggctacttcaagggcacataacaccagcaaggagcctgtcataaccaccatctcaaacaatagaacttcctaagtgaagcaatgacttcaaatctacttgaaggcatggagtataagccatgttcctttcagaggggactgtacttctgtagattactttccctcattaaccagatctggccggccgcatgcggtcgatcatgttggccactcttgtttatctatcattcctcgttggtccagtcacagttctaaaagtctatggtgttccttacattgtaagtttcatatatttcattattatatcattgctaatataatttgtttttgacataaagttttggaaaaatttcagatctttgtaatgtggttggacgctgtcacgtacttgcatcatcatggtcacgatgataagttgccttggtacagaggcaaggtaagtagatcaacattaatttataagaagcaacaatgattagtatttgattaatctaaattattgatgttttgtgtacaataataggaatggagttatttacgtggaggattaacaactattgatagagattacgggatcttcaacaacattcatcacgatattggaactcacgtgatccatcatcttttcccacaaatccctcactatcacttggttgatgccgtgagtgatctcgctctctctctagtttcatttgattaaaattaaagggtgattaattactaaattagtgatcttaattaatgatatgcgacagacgaaatcagctaaacatgtgttgggaagatactacagagaaccaaagacgtcaggagcaataccgatccacttggtggaaagtttggtggcaagtattaagaaagatcattacgtcagtgacactggtgatattgtcttctacgagacagatccagatctctacgtttatgcttctgacaaatccaaaatcaactaacctttcttcctagctctatttaggaataaaacagtcctttggtttttacttatttctggttgtttttaagttaaatgtactcgtgaaactttttttaattaaatgtatttacattacaaatcaagtttttgttcgttttctttatgtttttagttacaataaataaaggtcttaaaaactttttgttggtggggacaaaagaaaaagttcgactgagagagtcgacaaaatgcacgccg

SEQ ID NO: 147 - DNA, 5521 bp, Artificial Sequence
  T-strand Insert Region of pDAS000031
tggcaggatatattgtggtgtaaacaaattgacgcttagacaacttaataacacattgcggacgtttttaatgtactgaattaacgccgaattgaattcgagctcggtaccggggacaactttgtatagaaaagttgggtggtttaaactatgtattacaccataatatcgcactcagtctttcatctacggcaatgtaccagctgatataatcagttattgaaatatttctgaatttaaacttgcatcaataaatttatgtttttgcttggactataatacctgacttgttattttatcaataaatatttaaactatatttctttcaagatatcattctttacaagtatacgtgtttaaattgaataccataaatttttatttttcaaatacatgtaaaattatgaaatgggagtggtggcgaccgcaagcacacttcaattcctataacggaccaaatcgcaaaaattataataacatattatttcatcctggattaaaagaaagtcaccggggattattttgtgacgccgattacatacggcgacaataaagacattggaaatcgtagtacatattggaatacactgattatattagtgatgaatacatactttaatatccttacgtaggatcaacatatcttgttacaatcggacacttttgcttcatcccgctaacacctctgcaccttagaccaagcgcttccacaaggaactgagagccatagcccacctcaccttgggttcctttggccgcctgtctttctgaaagagagccttgcccaccgcaactatttcaacacagataggatcaacccgggatggcgctaagaagctattgccgccgatcttcacttcttggctctaggtctagtagaaggccttctgtttccagaatcagcgagaacttcaacacatccatcagtccaaacagcagcagatcttctagcgatttgagttcttccaacagttccagcaccagatctaacgatagcatcacatcttccctgagcccaagcagcatcatcgaagtttccatcaacgagagactggtaaagctgatcaagtccgatcctaagcatgtaagctctaagtctaggagatccagcaagctcaggatgccttctctcgaagtatctagtctgttgttccatacaagcaagccaaggcctccaaaagaatatgttggccacctcgtattgagaatctccgaacatagcctcagaccaatcgataacagcggtgattcttccgttatcggtgagaacgttgttagatccgaaatcagcgtgaacaagatgtctaacctcaggacaatcctcagcccaaagcataagctcatcaagagcttgagcaacagaagcagaaacggtatcatccataacggtctgccaatggtaaacatgaggatcagcgatagcgcagatgaaatctctccaagtagtgtactgtccgattccctgaggaccgaaaggtccgaatccagaagtttgagaaagatcagcagcagcgatagcatccatagcctcagcaacaggttgaagaacagcaggaagctcagtctcaggaagatcttgaagagtaacaccctgagcccttcttgagatacagtaggtaagagactcagagaactctccgatatcaagaacttcagggatagggagagcagctgaagcgaagtgtctgtacacgtatctatccttgtagaatccgtcagcgcaagagttaactctgagaacgtatcctcttccaccaacatcgaaagagaaagctcttgattcctcaccctcagagagctgcataagatcagacacagaatcgaacttctcgatgaggaacttctcaacagaagtagcagtaagctcaggcttcttcatgcttggaggtctgattttctcagtctccagagatgtgtttaaataggcagtagccttttgatatcagccacaagtgtgtgggaatcttatcttcggatttcaattaggaattaaccttattgaattctcttgaaaggaagtccgcaaagtggttgtcggttgtttaaaccaacttttgtatacaaagttgtcccctctagagtcgacctgcaggcatgcaagcttagcttgagcttggatcagattgtcgtttcccgccttcagtttatcacaagtttgtacaaaaaagcaggctgtcgacctgcaggtcaacggatcaggatattcttgtttaagatgttgaactctatggaggtttgtatgaactgatgatctaggaccggataagttcccttcttcatagcgaacttattcaaagaatgttttgtgtatcattcttgttacattgttattaatgaaaaaatattattggtcattggactgaacacgagtgttaaatatggaccaggccccaaataagatccattgatatatgaattaaataacaagaataaatcgagtcaccaaaccacttgccttttttaacgagacttgttcaccaacttgatacaaaagtcattatcctatgcaaatcaataatcatacaaaaatatccaataacactaaaaaattaaaagaaatggataatttcacaatatgttatacgataaagaagttacttttccaagaaattcactgattttataagcccacttgcattagataaatggcaaaaaaaaacaaaaaggaaaagaaataaagcacgaagaattctagaaaatacgaaatacgcttcaatgcagtgggacccacggttcaattattgccaattttcagctccaccgtatatttaaaaaataaaacgataatgctaaaaaaatataaatcgtaacgatcgttaaatctcaacggctggatcttatgacgaccgttagaaattgtggttgtcgacgagtcagtaataaacggcgtcaaagtggttgcagccggcacacacgagtcgtgtttatcaactcaaagcacaaatacttttcctcaacctaaaaataaggcaattagccaaaaacaactttgcgtgtaaacaacgctcaatacacgtgtcattttattattagctattgcttcaccgccttagctttctcgtgacctagtcgtcctcgtcttttcttcttcttcttctataaaacaatacccaaagagctcttcttcttcacaattcagatttcaatttctcaaaatcttaaaaactttctctcaattctctctaccgtgatcaaggtaaatttctgtgttccttattctctcaaaatcttcgattttgttttcgttcgatcccaatttcgtatatgttctttggtttagattctgttaatcttagatcgaagacgattttctgggtttgatcgttagatatcatcttaattctcgattagggtttcatagatatcatccgatttgttcaaataatttgagttttgtcgaataattactcttcgatttgtgatttctatctagatctggtgttagtttctagtttgtgcgatcgaatttgtcgattaatctgagtttttctgattaacagatggcttcatctgagaacgttatcactgagttcatgaggttcaaggtgaggatggaaggtactgttaacggacatgagttcgagatcgagggtgagggtgaaggtagaccttacgagggacataacaccgttaagcttaaggttacaaagggtggacctcttcctttcgcttgggatatcctttctcctcaattccaatacggaagcaaggtaagtttgtggattcttcgtccatgtgatctttgagtttctttagagcttgtgagggattagtaagtaacaatgcttgagttttttgctgctgggcttcgaaaagtttgtcacttgttggtttgatccacaaggtcttcttctccatagctactagacatgttttagcttaagattcaagtttatatatgccttgtggattaatcattgcctgattcttccgtgtcatctctgagtttatttagagcttggaagtggtgtagtaataactaacaatactcttgataagttgtagcaatgctcttgattagtggatgtaatatgatgttgataagatatatgaggcacagaaccaaaagtggtgcttccactagacccgtttttagcctaaggttcaagtttataccttgtagatgtttctgtattgtctgattcttccctgtgatatttgaatttcttagagctttggaagtgatataggaacaatgctcttgtgtgtttgtctctatgaagattatcgctgtcgtgtttcatccgagtgtgcgggattttttgctgctgggtttagcctttcttcaaaaagttattacttgttagttttattgttttggtcttgataagagatgttaggacagacatggtgcttcttgtctatagccactagacctattttagcataaggttaacgaaattctctctacataccttgtggatttgtttacattgcctgatctttcctgtgatcgctgtcatgtttctttggaatgattgatgtttataaatggaaaaatctttgtgcaggtttacgttaagcaccctgctgatatccctgattacaagaagctttcattccctgagggattcaagtgggagagagttatgaacttcgaggatggtggtgttgctactgttactcaggattcttcacttcaggacggatgcttcatctacaaggttaagttcatcggagtgaacttcccttctgatggacctgttatgcagaaaaagactatgggatgggaggcttctaccgagagactttaccctagagatggtgttcttaagggtgagactcacaaggctcttaagcttaaagatggtggacactacctcgtcgagttcaagtctatctacatggctaagaagcctgttcagcttcctggttactactacgttgacgctaagcttgatatcacctctcacaacgaggactacactatcgttgagcaatacgagagaactgagggtagacatcacttgttcctctgatatcaaaatctatttagaaatacacaatattttgttgcaggcttgctggagaatcgatctgctatcataaaaattacaaaaaaattttatttgcctcaattattttaggattggtattaaggacgcttaaattatttgtcgggtcactacgcatcattgtgattgagaagatcagcgatacgaaatattcgtagtactatcgataatttatttgaaaattcataagaaaagcaaacgttacatgaattgatgaaacaatacaaagacagataaagccacgcacatttaggatattggccgagattactgaatattgagtaagatcacggaatttctgacaggagcatgtcttcaattcagcccaaatggcagttgaaatactcaaaccgccccatatgcaggagcggatcattcattgtttgtttggttgcctttgccaacatgggagtccaaggtttacccagctttcttgtacaaagtggtgataaactatcagtgtttgacaggatatattggcgggtaaacctaagagaaaagagcgt

SEQ ID NO: 148 - DNA, 11708 bp, Artificial Sequence
  T-strand Insert Region of pDAS000036
tggcaggatatattgtggtgtaaacaaattgacgcttagacaacttaataacacattgcggacgtttttaatgtactgaattaacgccgaattgaattcgagctcggtacccggggatcctctagagtcgacctgcaggcatgcaagcttagcttgagcttggatcagattgtcgtttcccgccttcagtttatcacaagtttgtacaaaaaagcaggcgccttttgcagtttatctctatgcccgggacaagtggagtccatgctcaacaccgtgcaggatgaggatgaccatagcgacttcgtgggcgaggaaagcctttcgtccaaggtggtccctcctcgcaatcttgttggatggtgaatattataaaagcctgcccttctcgcgggtgtttaaacgtcgacctgcaggtcaacggatcaggatattcttgtttaagatgttgaactctatggaggtttgtatgaactgatgatctaggaccggataagttcccttcttcatagcgaacttattcaaagaatgttttgtgtatcattcttgttacattgttattaatgaaaaaatattattggtcattggactgaacacgagtgttaaatatggaccaggccccaaataagatccattgatatatgaattaaataacaagaataaatcgagtcaccaaaccacttgccttttttaacgagacttgttcaccaacttgatacaaaagtcattatcctatgcaaatcaataatcatacaaaaatatccaataacactaaaaaattaaaagaaatggataatttcacaatatgttatacgataaagaagttacttttccaagaaattcactgattttataagcccacttgcattagataaatggcaaaaaaaaacaaaaaggaaaagaaataaagcacgaagaattctagaaaatacgaaatacgcttcaatgcagtgggacccacggttcaattattgccaattttcagctccaccgtatatttaaaaaataaaacgataatgctaaaaaaatataaatcgtaacgatcgttaaatctcaacggctggatcttatgacgaccgttagaaattgtggttgtcgacgagtcagtaataaacggcgtcaaagtggttgcagccggcacacacgagtcgtgtttatcaactcaaagcacaaatacttttcctcaacctaaaaataaggcaattagccaaaaacaactttgcgtgtaaacaacgctcaatacacgtgtcattttattattagctattgcttcaccgccttagctttctcgtgacctagtcgtcctcgtcttttcttcttcttcttctataaaacaatacccaaagagctcttcttcttcacaattcagatttcaatttctcaaaatcttaaaaactttctctcaattctctctaccgtgatcaaggtaaatttctgtgttccttattctctcaaaatcttcgattttgttttcgttcgatcccaatttcgtatatgttctttggtttagattctgttaatcttagatcgaagacgattttctgggtttgatcgttagatatcatcttaattctcgattagggtttcatagatatcatccgatttgttcaaataatttgagttttgtcgaataattactcttcgatttgtgatttctatctagatctggtgttagtttctagtttgtgcgatcgaatttgtcgattaatctgagtttttctgattaacagatggcttcatctgagaacgttatcactgagttcatgaggttcaaggtgaggatggaaggtactgttaacggacatgagttcgagatcgagggtgagggtgaaggtagaccttacgagggacataacaccgttaagcttaaggttacaaagggtggacctcttcctttcgcttgggatatcctttctcctcaattccaatacggaagcaaggtaagtttgtggattcttcgtccatgtgatctttgagtttctttagagcttgtgagggattagtaagtaacaatgcttgagttttttgctgctgggcttcgaaaagtttgtcacttgttggtttgatccacaaggtcttcttctccatagctactagacatgttttagcttaagattcaagtttatatatgccttgtggattaatcattgcctgattcttccgtgtcatctctgagtttatttagagcttggaagtggtgtagtaataactaacaatactcttgataagttgtagcaatgctcttgattagtggatgtaatatgatgttgataagatatatgaggcacagaaccaaaagtggtgcttccactagacccgtttttagcctaaggttcaagtttataccttgtagatgtttctgtattgtctgattcttccctgtgatatttgaatttcttagagctttggaagtgatataggaacaatgctcttgtgtgtttgtctctatgaagattatcgctgtcgtgtttcatccgagtgtgcgggattttttgctgctgggtttagcctttcttcaaaaagttattacttgttagttttattgttttggtcttgataagagatgttaggacagacatggtgcttcttgtctatagccactagacctattttagcataaggttaacgaaattctctctacataccttgtggatttgtttacattgcctgatctttcctgtgatcgctgtcatgtttctttggaatgattgatgtttataaatggaaaaatctttgtgcagaagactcccgcccatccaggatgaggatgaccaccaccccacagtggggcaggatgaggatgaccaggtcgcagcgtgtgcgtgtccgtcgtacgttctggccggccgggccttgggcgcgcgatcagaagcgttgcgttggcgtgtgtgtgcttctggtttgctttaattttaccaagtttgtttcaaggtggatcgcgtggtcaaggcccgtgtgctttaaagacccaccggcactggcagtgagtgttgctgcttgtgtaggctttggtacgtatgggctttatttgcttctggatgttgtgtactacttgggtttgttgaattattatgagcagttgcgtattgtaattcagctgggctacctggacattgttatgtattaataaatgctttgctttcttctaaagatctttaagtgctacaactttgtatacaaaagttggtttaaacaaccgacaaccactttgcggacttcctttcaagagaattcaataaggttaattcctaattgaaatccgaagataagattcccacacacttgtggctgatatcaaaaggctactgcctatttaaacacatctctggagactgagaaaatcagacctccaagcatgaagaagcctgagcttactgctacttctgttgagaagttcctcatcgagaagttcgattctgtgtctgatcttatgcagctctctgagggtgaggaatcaagagctttctctttcgatgttggtggaagaggatacgttctcagagttaactcttgcgctgacggattctacaaggatagatacgtgtacagacacttcgcttcagctgctctccctatccctgaagttcttgatatcggagagttctctgagtctcttacctactgtatctcaagaagggctcagggtgttactcttcaagatcttcctgagactgagcttcctgctgttcttcaacctgttgctgaggctatggatgctatcgctgctgctgatctttctcaaacttctggattcggacctttcggtcctcagggaatcggacagtacactacttggagagatttcatctgcgctatcgctgatcctcatgtttaccattggcagaccgttatggatgataccgtttctgcttctgttgctcaagctcttgatgagcttatgctttgggctgaggattgtcctgaggttagacatcttgttcacgctgatttcggatctaacaacgttctcaccgataacggaagaatcaccgctgttatcgattggtctgaggctatgttcggagattctcaatacgaggtggccaacatattcttttggaggccttggcttgcttgtatggaacaacagactagatacttcgagagaaggcatcctgagcttgctggatctcctagacttagagcttacatgcttaggatcggacttgatcagctttaccagtctctcgttgatggaaacttcgatgatgctgcttgggctcagggaagatgtgatgctatcgttagatctggtgctggaactgttggaagaactcaaatcgctagaagatctgctgctgtttggactgatggatgtgttgaagttctcgctgattctggaaacagaaggccttctactagacctagagccaagaagtgaagatcggcggcaatagcttcttagcgccatcccgggttgatcctatctgtgttgaaatagttgcggtgggcaaggctctctttcagaaagacaggcggccaaaggaacccaaggtgaggtgggctatggctctcagttccttgtggaagcgcttggtctaaggtgcagaggtgttagcgggatgaagcaaaagtgtccgattgtaacaagatatgttgatcctacgtaaggatattaaagtatgtattcatcactaatataatcagtgtattccaatatgtactacgatttccaatgtctttattgtcgccgtatgtaatcggcgtcacaaaataatccccggtgactttcttttaatccaggatgaaataatatgttattataatttttgcgatttggtccgttataggaattgaagtgtgcttgcggtcgccaccactcccatttcataattttacatgtatttgaaaaataaaaatttatggtattcaatttaaacacgtatacttgtaaagaatgatatcttgaaagaaatatagtttaaatatttattgataaaataacaagtcaggtattatagtccaagcaaaaacataaatttattgatgcaagtttaaattcagaaatatttcaataactgattatatcagctggtacattgccgtagatgaaagactgagtgcgatattatggtgtaatacatagtttaaaccacccaacttttctatacaaagttgaagactcccgcccatccaggatgaggatgaccaccaccccacagtggggcaggatgaggatgaccagtcagttttacttcccttaattttctatgtactttcataattacttatgttattttcttcatgagttttaatgcaaattactatatggactctagtgaaaacgttcagaatcctataaacatgactactgagacgaacttgagagtagttttgatcatacacacgtttcatgtggtacttgagagttactaatttttgtcatcttcgtataagtagtaaaagatactacaagaatagtttagtagaaaatactagcggtaggtgaagatttgtcgctatgtactattattgtctagtaacttgagtaacaatttcgtggtctaaatatcaaataaaaatggatgagtggttcaccaaatctaggcatcaaaactattaatgtcattgtctagatcttaggtgacaccacatttcgaatatttattggtaattgagatgttaaagtaccaatatttgacttaataaactaaaagattttggctttatcaaatgtagacattgatgacatatcgttgtcattatcttgagtatatacaagtcgatcaattaggtgaaagtttagtgtctcgtggttggtaaacgattaatacagtagtatattttatccaaagacaaaatccaaatcatttcaccagtatgaatagtattattttatcttaaaagctaaaatcttaaaaaccaaggtagcacccacgttgagctagacgatcaaatcgatttctgctttgtccaatttaccaagctatttaaagccaaataattgaaatataggtaggtcgttatattaggctaagatttatctcaaatgcttaactaaaggaataacaagggattctagttgtgtggttttataagattggtccaatttcacttaagtttgtttattgtagaattttatatgtgaataatttgaattccaattgaaaagatattatagtaaaagaaaaaatagtgcgaacaaaaaactttaatcccataaaaagaaaaagaaaaatgaaaagttcttctaacatccatattttgcatcatatcataaagataagaaagatacatatcatagacgtacagataaacaaacatatcatcatttgtgaaatacatagtacaataatttgcttttaaatagagtttaagtcacacacactgacacacacgataaaacgataatgtctgcaaaaacactttaatcccattgcctagaggacagcttctccactttgtctttaaggttggttttgccgtgttgtttttatctttatataatgatctattttttggattatgaaatgaattcacacattttaattatttaagaagatccatatacaggtttataacagtactaagtgatgattattttttgtttttgcatagtttagtttattgggtaaacattcattacgtgtctctttatacgaatcacccatccaaaatttcaagtagtcttttagttcatttattatttcataactatttgacttattgatttgacaagaaacaacaaaagtgttgacttattgatagattgtgggatcataaaagtaattaagcgtcaaccacgacccacaacaacaaagcacatgttatacattaatatctcgtttacttaattacagttttcagaatgccgtttcatgtcttgtcactggcgatgttattatcatgttggacaatattcgactgttgtcgtttttacattttcgtattgactaaaactaaaaaaacaaaactctgtttcaggttgggcctaggatccacattgtacacacatttgcttaagtctatggaggcgcaaggttttaagtctgtggttgctgttataggccttccaaacgatccatctgttaggttgcatgaggctttgggatacacagcccggggtacattgcgcgcagctggatacaagcatggtggatggcatgatgttggtttttggcaaagggattttgagttgccagctcctccaaggccagttaggccagttacccagatctaatatcaaaatctatttagaaatacacaatattttgttgcaggcttgctggagaatcgatctgctatcataaaaattacaaaaaaattttatttgcctcaattattttaggattggtattaaggacgcttaaattatttgtcgggtcactacgcatcattgtgattgagaagatcagcgatacgaaatattcgtagtactatcgataatttatttgaaaattcataagaaaagcaaacgttacatgaattgatgaaacaatacaaagacagataaagccacgcacatttaggatattggccgagattactgaatattgagtaagatcacggaatttctgacaggagcatgtcttcaattcagcccaaatggcagttgaaatactcaaaccgccccatatgcaggagcggatcattcattgtttgtttggttgcctttgccaacatgggagtccaaggttatttaaataccctgccaagcttgaggtagcctccaatttgacggtgccgccagcgacgccgtctggaactgtcctttttgaggaccactccgtttgtggagatcatgaacaactttgtataataaagttgaagactcccgcccatctctctatgcccgggacaagtggagtccatgctcaacaccgtgcactagggacaggattggtttaaacgtttgtgtcttctagattaatcctccaaacttttgattaaccaaaaaaattatcaaactaacatgttctccttttttctttagaaattctaacgaatttatctttatactgatttgaatatacttaatttggtcatttggatgccctttacaacctccttaccaaactattgatcacagtttctattgctaaaatcaccaacaaaacgcatgtcgccattcataattatggtttcacacctacaactaggctaataagtaaataagtagacaactagactcaggtttgaaaaaaccataaaagccatatagcgttttctcattgaaactgcgaacacgatcgtgtgaatgttgcagtttctagttttgatacaaacaaacaaaaacacaatttaatcttagattaaaaagaaaaaagagaacggagcccactagccactccttcaaacgtgtcttaccaactctcttctagaaacaaattaggcttcaccttcctcttccaacctctctctctctctctctctctttttctcaaaccatctctccataaagccctaatttcttcatcacaagaatcagaagaagaaagatggacctgcatctaattttcggtccaacttgcacaggaaagacgacgaccgcgatagctcttgcccagcagacagggcttccagtcctttcgcttgatcgggtccaatgctgtcctcaactatcaaccggaagcggacgaccaacagtggaagaactgaaaggaacgacgcgtctctaccttgatgatcggcctctggtggagggtatcatcgcagccaagcaagctcatcataggctgatcgaggaggtgtataatcatgaggccaacggcgggcttattcttgagggaggatccacctcgttgctcaactgcatggcgcgaaacagctattggagtgcagattttcgttggcatattattcgccacaagttacccgaccaagagaccttcatgaaagcggccaaggccagagttaagcagatgttgcaccccgctgcaggccattctattattcaagagttggtttatctttggaatgaacctcggctgaggcccattctgaaagagatcgatggatatcgatatgccatgttgtttgctagccagaaccagatcacggcagatatgctattgcagcttgacgcaaatatggaaggtaagttgattaatgggatcgctcaggagtatttcatccatgcgcgccaacaggaacagaaattcccccaagttaacgcagccgctttcgacggattcgaaggtcatccgttcggaatgtattagaaatcaccagtctctctctacaaatctatctctctctatttttctccagaataatgtgtgagtagttcccagataagggaattagggttcttatagggtttcgctcatgtgttgagcatataagaaacccttagtatgtatttgtatttgtaaaatacttctatcaataaaatttctaattcctaaaaccaaaatccagtgtttaaacaagactcccgcccatctctctatgcccgggacaagtggagtccatgctcaacaccgtgcactagggacaggattgcattaaggatgaccagttcgtaaaggtcctgcggtgtctattgcttttcataggttaataagtgtttgctagactgtggtgaaaggcctatccgaagtaaggccggccggatccttcatctttggacaagggaataaagactccccacttgctactaagaacaatacctaagttgcccagacatgactgtacccattcagagacctaccacccattagggctatgacactaacactagcccctggaggttgaccatgctaggcagtgggggtctcacctatgacccactcagataggggtttaaaccagtgggtgggatctcagcctcatataggtgtttgtggtgagctttctcctagacaagagaaccctgaagaacagcaagaaccagctaatatgatatgtagacatagtgggttgctcaaattttgtgtttagtcatattagaattgacctcagtgaccactcagaaagtgcccaagcccatctataggggccaaagtgctattgactggtgtgtctgtgaattgttcctccctacagagttggtgctgatatatcctagcattctttggaaaacctagctagggactgtcaagtgtaagatacctcctgaattggagggaacactagctgccctgtaccttctggctagtaccttacaccctgaatgggttagggggtctattatttgctggaaatataccagtttcagtagggctgctgccttaggtcccacaaggtgtaacatgtgctcaatagttgcactaccacatgcacgtgaacttaatgatgttatagccacaacaccaaccttggtttgcagtttgacatccctctggaatgggtgtagtcatcttgctctggatctgcctgaatcattggggctgtatgcagcctgggcttaaagtgaagaatgggatgtcccagaaatattttgggtgagaagaatcctggagtagatggtgacctgactatccctgtcctatgggcacaatctatcatcagatattgcattcaaagggctatcatgggatcaagtcctaagtcaactgttgtttacctggcagacattcatctaggagttctcttttatgccaccccacagtgatccgccttttgcagtttatccactagggacaggattgccaccccacagtggggcctctatgcccgggacaagtgtaaaatatagagtataggggttatcatcacagagaagctattgctggagggcctctgttatttcctctccatgccactcccatttttaacctaccaactgaaatcccaagggagactccaccctgtaactagagtcctcagaggtgagccatcccatattaacaaatgggcattagggctaggatgccaagggatacctgaaatgggaagttgtggggctgagtcctcctgggaatcagagataatatgtaaacagtttgttgagagattgatgagagctgactttgagaggtggccatgctccctggtcctcaatagggaaggcactacacaagaaacctgggtttgatcaactgcactgtgtcctactcacacattgtgtgcctggaaaaatgttacttagtatttggagggcctccagaacccccctgggtgcaagactgggtgctagtgactgggtgaatgagtcttggacacagtggccttgtctaggttgtgtgaggtggctaggcatcatggcaatacctcataattgatgagtgaggaaacaagactaagtccttgactcctcttattacatgacctggtggatattatgtttaaactctgcaagctggaatgagtactgggtgcagatcccctgggattctggctacaaaggtgaatgatagctagtctgtttattagtagccaaaaaagtcagtgaggggtgagtgccctgggatgttgttaagttcacattgcacacttggagaccctctccatccagtaacataccagagaaaactgaccaagccctcatgggtgtatgggaacaacaaacctcctggctacttcaagggcacataacaccagcaaggagcctgtcataaccaccatctcaaacaatagaacttcctaagtgaagcaatgacttcaaatctacttgaaggcatggagtataagccatgttcctttcagaggggactgtacttctgtagattactttccctcattaaccagatctggccggcctacccagctttcttgtacaaagtggtgataaactatcagtgtttgacaggatatattggcgggtaaac

SEQ ID NO: 149 - DNA, 11707 bp, Artificial Sequence
  T-strand Insert Region of pDAS000037
tggcaggatatattgtggtgtaaacaaattgacgcttagacaacttaataacacattgcggacgtttttaatgtactgaattaacgccgaattgaattcgagctcggtacccggggatcctctagagtcgacctgcaggcatgcaagcttagcttgagcttggatcagattgtcgtttcccgccttcagtttatcacaagtttgtacaaaaaagcaggctaagactcccgcccatctcactagggacaggattggagtccatgctcaacaccgtgcaggatgaggatgaccatagcgacttcgtgggcgaggaaagcctttcgtccaaggtggtccctcctcgcaatcttgttggatggtgaatattataaaagcctgcccttctcgcgggtgtttaaacgtcgacctgcaggtcaacggatcaggatattcttgtttaagatgttgaactctatggaggtttgtatgaactgatgatctaggaccggataagttcccttcttcatagcgaacttattcaaagaatgttttgtgtatcattcttgttacattgttattaatgaaaaaatattattggtcattggactgaacacgagtgttaaatatggaccaggccccaaataagatccattgatatatgaattaaataacaagaataaatcgagtcaccaaaccacttgccttttttaacgagacttgttcaccaacttgatacaaaagtcattatcctatgcaaatcaataatcatacaaaaatatccaataacactaaaaaattaaaagaaatggataatttcacaatatgttatacgataaagaagttacttttccaagaaattcactgattttataagcccacttgcattagataaatggcaaaaaaaaacaaaaaggaaaagaaataaagcacgaagaattctagaaaatacgaaatacgcttcaatgcagtgggacccacggttcaattattgccaattttcagctccaccgtatatttaaaaaataaaacgataatgctaaaaaaatataaatcgtaacgatcgttaaatctcaacggctggatcttatgacgaccgttagaaattgtggttgtcgacgagtcagtaataaacggcgtcaaagtggttgcagccggcacacacgagtcgtgtttatcaactcaaagcacaaatacttttcctcaacctaaaaataaggcaattagccaaaaacaactttgcgtgtaaacaacgctcaatacacgtgtcattttattattagctattgcttcaccgccttagctttctcgtgacctagtcgtcctcgtcttttcttcttcttcttctataaaacaatacccaaagagctcttcttcttcacaattcagatttcaatttctcaaaatcttaaaaactttctctcaattctctctaccgtgatcaaggtaaatttctgtgttccttattctctcaaaatcttcgattttgttttcgttcgatcccaatttcgtatatgttctttggtttagattctgttaatcttagatcgaagacgattttctgggtttgatcgttagatatcatcttaattctcgattagggtttcatagatatcatccgatttgttcaaataatttgagttttgtcgaataattactcttcgatttgtgatttctatctagatctggtgttagtttctagtttgtgcgatcgaatttgtcgattaatctgagtttttctgattaacagatggcttcatctgagaacgttatcactgagttcatgaggttcaaggtgaggatggaaggtactgttaacggacatgagttcgagatcgagggtgagggtgaaggtagaccttacgagggacataacaccgttaagcttaaggttacaaagggtggacctcttcctttcgcttgggatatcctttctcctcaattccaatacggaagcaaggtaagtttgtggattcttcgtccatgtgatctttgagtttctttagagcttgtgagggattagtaagtaacaatgcttgagttttttgctgctgggcttcgaaaagtttgtcacttgttggtttgatccacaaggtcttcttctccatagctactagacatgttttagcttaagattcaagtttatatatgccttgtggattaatcattgcctgattcttccgtgtcatctctgagtttatttagagcttggaagtggtgtagtaataactaacaatactcttgataagttgtagcaatgctcttgattagtggatgtaatatgatgttgataagatatatgaggcacagaaccaaaagtggtgcttccactagacccgtttttagcctaaggttcaagtttataccttgtagatgtttctgtattgtctgattcttccctgtgatatttgaatttcttagagctttggaagtgatataggaacaatgctcttgtgtgtttgtctctatgaagattatcgctgtcgtgtttcatccgagtgtgcgggattttttgctgctgggtttagcctttcttcaaaaagttattacttgttagttttattgttttggtcttgataagagatgttaggacagacatggtgcttcttgtctatagccactagacctattttagcataaggttaacgaaattctctctacataccttgtggatttgtttacattgcctgatctttcctgtgatcgctgtcatgtttctttggaatgattgatgtttataaatggaaaaatctttgtgcagaagactcccgcccatccaggatgaggatgaccaccaccccacagtggggcaggatgaggatgaccaggtcgcagcgtgtgcgtgtccgtcgtacgttctggccggccgggccttgggcgcgcgatcagaagcgttgcgttggcgtgtgtgtgcttctggtttgctttaattttaccaagtttgtttcaaggtggatcgcgtggtcaaggcccgtgtgctttaaagacccaccggcactggcagtgagtgttgctgcttgtgtaggctttggtacgtatgggctttatttgcttctggatgttgtgtactacttgggtttgttgaattattatgagcagttgcgtattgtaattcagctgggctacctggacattgttatgtattaataaatgctttgctttcttctaaagatctttaagtgctacaactttgtatacaaaagttggtttaaacaaccgacaaccactttgcggacttcctttcaagagaattcaataaggttaattcctaattgaaatccgaagataagattcccacacacttgtggctgatatcaaaaggctactgcctatttaaacacatctctggagactgagaaaatcagacctccaagcatgaagaagcctgagcttactgctacttctgttgagaagttcctcatcgagaagttcgattctgtgtctgatcttatgcagctctctgagggtgaggaatcaagagctttctctttcgatgttggtggaagaggatacgttctcagagttaactcttgcgctgacggattctacaaggatagatacgtgtacagacacttcgcttcagctgctctccctatccctgaagttcttgatatcggagagttctctgagtctcttacctactgtatctcaagaagggctcagggtgttactcttcaagatcttcctgagactgagcttcctgctgttcttcaacctgttgctgaggctatggatgctatcgctgctgctgatctttctcaaacttctggattcggacctttcggtcctcagggaatcggacagtacactacttggagagatttcatctgcgctatcgctgatcctcatgtttaccattggcagaccgttatggatgataccgtttctgcttctgttgctcaagctcttgatgagcttatgctttgggctgaggattgtcctgaggttagacatcttgttcacgctgatttcggatctaacaacgttctcaccgataacggaagaatcaccgctgttatcgattggtctgaggctatgttcggagattctcaatacgaggtggccaacatattcttttggaggccttggcttgcttgtatggaacaacagactagatacttcgagagaaggcatcctgagcttgctggatctcctagacttagagcttacatgcttaggatcggacttgatcagctttaccagtctctcgttgatggaaacttcgatgatgctgcttgggctcagggaagatgtgatgctatcgttagatctggtgctggaactgttggaagaactcaaatcgctagaagatctgctgctgtttggactgatggatgtgttgaagttctcgctgattctggaaacagaaggccttctactagacctagagccaagaagtgaagatcggcggcaatagcttcttagcgccatcccgggttgatcctatctgtgttgaaatagttgcggtgggcaaggctctctttcagaaagacaggcggccaaaggaacccaaggtgaggtgggctatggctctcagttccttgtggaagcgcttggtctaaggtgcagaggtgttagcgggatgaagcaaaagtgtccgattgtaacaagatatgttgatcctacgtaaggatattaaagtatgtattcatcactaatataatcagtgtattccaatatgtactacgatttccaatgtctttattgtcgccgtatgtaatcggcgtcacaaaataatccccggtgactttcttttaatccaggatgaaataatatgttattataatttttgcgatttggtccgttataggaattgaagtgtgcttgcggtcgccaccactcccatttcataattttacatgtatttgaaaaataaaaatttatggtattcaatttaaacacgtatacttgtaaagaatgatatcttgaaagaaatatagtttaaatatttattgataaaataacaagtcaggtattatagtccaagcaaaaacataaatttattgatgcaagtttaaattcagaaatatttcaataactgattatatcagctggtacattgccgtagatgaaagactgagtgcgatattatggtgtaatacatagtttaaaccacccaacttttctatacaaagttgaagactcccgcccatccaggatgaggatgaccaccaccccacagtggggcaggatgaggatgaccagtcagttttacttcccttaattttctatgtactttcataattacttatgttattttcttcatgagttttaatgcaaattactatatggactctagtgaaaacgttcagaatcctataaacatgactactgagacgaacttgagagtagttttgatcatacacacgtttcatgtggtacttgagagttactaatttttgtcatcttcgtataagtagtaaaagatactacaagaatagtttagtagaaaatactagcggtaggtgaagatttgtcgctatgtactattattgtctagtaacttgagtaacaatttcgtggtctaaatatcaaataaaaatggatgagtggttcaccaaatctaggcatcaaaactattaatgtcattgtctagatcttaggtgacaccacatttcgaatatttattggtaattgagatgttaaagtaccaatatttgacttaataaactaaaagattttggctttatcaaatgtagacattgatgacatatcgttgtcattatcttgagtatatacaagtcgatcaattaggtgaaagtttagtgtctcgtggttggtaaacgattaatacagtagtatattttatccaaagacaaaatccaaatcatttcaccagtatgaatagtattattttatcttaaaagctaaaatcttaaaaaccaaggtagcacccacgttgagctagacgatcaaatcgatttctgctttgtccaatttaccaagctatttaaagccaaataattgaaatataggtaggtcgttatattaggctaagatttatctcaaatgcttaactaaaggaataacaagggattctagttgtgtggttttataagattggtccaatttcacttaagtttgtttattgtagaattttatatgtgaataatttgaattccaattgaaaagatattatagtaaaagaaaaaatagtgcgaacaaaaaactttaatcccataaaaagaaaaagaaaaatgaaaagttcttctaacatccatattttgcatcatatcataaagataagaaagatacatatcatagacgtacagataaacaaacatatcatcatttgtgaaatacatagtacaataatttgcttttaaatagagtttaagtcacacacactgacacacacgataaaacgataatgtctgcaaaaacactttaatcccattgcctagaggacagcttctccactttgtctttaaggttggttttgccgtgttgtttttatctttatataatgatctattttttggattatgaaatgaattcacacattttaattatttaagaagatccatatacaggtttataacagtactaagtgatgattattttttgtttttgcatagtttagtttattgggtaaacattcattacgtgtctctttatacgaatcacccatccaaaatttcaagtagtcttttagttcatttattatttcataactatttgacttattgatttgacaagaaacaacaaaagtgttgacttattgatagattgtgggatcataaaagtaattaagcgtcaaccacgacccacaacaacaaagcacatgttatacattaatatctcgtttacttaattacagttttcagaatgccgtttcatgtcttgtcactggcgatgttattatcatgttggacaatattcgactgttgtcgtttttacattttcgtattgactaaaactaaaaaaacaaaactctgtttcaggttgggcctaggatccacattgtacacacatttgcttaagtctatggaggcgcaaggttttaagtctgtggttgctgttataggccttccaaacgatccatctgttaggttgcatgaggctttgggatacacagcccggggtacattgcgcgcagctggatacaagcatggtggatggcatgatgttggtttttggcaaagggattttgagttgccagctcctccaaggccagttaggccagttacccagatctaatatcaaaatctatttagaaatacacaatattttgttgcaggcttgctggagaatcgatctgctatcataaaaattacaaaaaaattttatttgcctcaattattttaggattggtattaaggacgcttaaattatttgtcgggtcactacgcatcattgtgattgagaagatcagcgatacgaaatattcgtagtactatcgataatttatttgaaaattcataagaaaagcaaacgttacatgaattgatgaaacaatacaaagacagataaagccacgcacatttaggatattggccgagattactgaatattgagtaagatcacggaatttctgacaggagcatgtcttcaattcagcccaaatggcagttgaaatactcaaaccgccccatatgcaggagcggatcattcattgtttgtttggttgcctttgccaacatgggagtccaaggttatttaaataccctgccaagcttgaggtagcctccaatttgacggtgccgccagcgacgccgtctggaactgtcctttttgaggaccactccgtttgtggagatcatgaacaactttgtataataaagttgaagactcccgcccatctctctatgcccgggacaagtggagtccatgctcaacaccgtgcactagggacaggattggtttaaacgtttgtgtcttctagattaatcctccaaacttttgattaaccaaaaaaattatcaaactaacatgttctccttttttctttagaaattctaacgaatttatctttatactgatttgaatatacttaatttggtcatttggatgccctttacaacctccttaccaaactattgatcacagtttctattgctaaaatcaccaacaaaacgcatgtcgccattcataattatggtttcacacctacaactaggctaataagtaaataagtagacaactagactcaggtttgaaaaaaccataaaagccatatagcgttttctcattgaaactgcgaacacgatcgtgtgaatgttgcagtttctagttttgatacaaacaaacaaaaacacaatttaatcttagattaaaaagaaaaaagagaacggagcccactagccactccttcaaacgtgtcttaccaactctcttctagaaacaaattaggcttcaccttcctcttccaacctctctctctctctctctctctttttctcaaaccatctctccataaagccctaatttcttcatcacaagaatcagaagaagaaagatggacctgcatctaattttcggtccaacttgcacaggaaagacgacgaccgcgatagctcttgcccagcagacagggcttccagtcctttcgcttgatcgggtccaatgctgtcctcaactatcaaccggaagcggacgaccaacagtggaagaactgaaaggaacgacgcgtctctaccttgatgatcggcctctggtggagggtatcatcgcagccaagcaagctcatcataggctgatcgaggaggtgtataatcatgaggccaacggcgggcttattcttgagggaggatccacctcgttgctcaactgcatggcgcgaaacagctattggagtgcagattttcgttggcatattattcgccacaagttacccgaccaagagaccttcatgaaagcggccaaggccagagttaagcagatgttgcaccccgctgcaggccattctattattcaagagttggtttatctttggaatgaacctcggctgaggcccattctgaaagagatcgatggatatcgatatgccatgttgtttgctagccagaaccagatcacggcagatatgctattgcagcttgacgcaaatatggaaggtaagttgattaatgggatcgctcaggagtatttcatccatgcgcgccaacaggaacagaaattcccccaagttaacgcagccgctttcgacggattcgaaggtcatccgttcggaatgtattagaaatcaccagtctctctctacaaatctatctctctctatttttctccagaataatgtgtgagtagttcccagataagggaattagggttcttatagggtttcgctcatgtgttgagcatataagaaacccttagtatgtatttgtatttgtaaaatacttctatcaataaaatttctaattcctaaaaccaaaatccagtgtttaaacaagactcccgcccatctctctatgcccgggacaagtggagtccatgctcaacaccgtgcactagggacaggattgcattaaggatgaccagttcgtaaaggtcctgcggtgtctattgcttttcataggttaataagtgtttgctagactgtggtgaaaggcctatccgaagtaaggccggccggatccttcatctttggacaagggaataaagactccccacttgctactaagaacaatacctaagttgcccagacatgactgtacccattcagagacctaccacccattagggctatgacactaacactagcccctggaggttgaccatgctaggcagtgggggtctcacctatgacccactcagataggggtttaaaccagtgggtgggatctcagcctcatataggtgtttgtggtgagctttctcctagacaagagaaccctgaagaacagcaagaaccagctaatatgatatgtagacatagtgggttgctcaaattttgtgtttagtcatattagaattgacctcagtgaccactcagaaagtgcccaagcccatctataggggccaaagtgctattgactggtgtgtctgtgaattgttcctccctacagagttggtgctgatatatcctagcattctttggaaaacctagctagggactgtcaagtgtaagatacctcctgaattggagggaacactagctgccctgtaccttctggctagtaccttacaccctgaatgggttagggggtctattatttgctggaaatataccagtttcagtagggctgctgccttaggtcccacaaggtgtaacatgtgctcaatagttgcactaccacatgcacgtgaacttaatgatgttatagccacaacaccaaccttggtttgcagtttgacatccctctggaatgggtgtagtcatcttgctctggatctgcctgaatcattggggctgtatgcagcctgggcttaaagtgaagaatgggatgtcccagaaatattttgggtgagaagaatcctggagtagatggtgacctgactatccctgtcctatgggcacaatctatcatcagatattgcattcaaagggctatcatgggatcaagtcctaagtcaactgttgtttacctggcagacattcatctaggagttctcttttatgccaccccacagtgatccgccttttgcagtttatccactagggacaggattgccaccccacagtggggcctctatgcccgggacaagtgtaaaatatagagtataggggttatcatcacagagaagctattgctggagggcctctgttatttcctctccatgccactcccatttttaacctaccaactgaaatcccaagggagactccaccctgtaactagagtcctcagaggtgagccatcccatattaacaaatgggcattagggctaggatgccaagggatacctgaaatgggaagttgtggggctgagtcctcctgggaatcagagataatatgtaaacagtttgttgagagattgatgagagctgactttgagaggtggccatgctccctggtcctcaatagggaaggcactacacaagaaacctgggtttgatcaactgcactgtgtcctactcacacattgtgtgcctggaaaaatgttacttagtatttggagggcctccagaacccccctgggtgcaagactgggtgctagtgactgggtgaatgagtcttggacacagtggccttgtctaggttgtgtgaggtggctaggcatcatggcaatacctcataattgatgagtgaggaaacaagactaagtccttgactcctcttattacatgacctggtggatattatgtttaaactctgcaagctggaatgagtactgggtgcagatcccctgggattctggctacaaaggtgaatgatagctagtctgtttattagtagccaaaaaagtcagtgaggggtgagtgccctgggatgttgttaagttcacattgcacacttggagaccctctccatccagtaacataccagagaaaactgaccaagccctcatgggtgtatgggaacaacaaacctcctggctacttcaagggcacataacaccagcaaggagcctgtcataaccaccatctcaaacaatagaacttcctaagtgaagcaatgacttcaaatctacttgaaggcatggagtataagccatgttcctttcagaggggactgtacttctgtagattactttccctcattaaccagatctggccggcctacccagctttcttgtacaaagtggtgataaactatcagtgtttgacaggatatattggcgggtaaac

SEQ ID NO: 150 - DNA, 18 bp, Artificial Sequence
  pTiC58 Forward    PCR  Primer
cgagaacttggcaattcc

SEQ ID NO: 151 - DNA, 18 bp, Artificial Sequence
  pTiC58 Reverse   PCR Primer
tggcgattctgagattcc

SEQ ID NO: 152 - DNA, 22 bp, Artificial Sequence
  Actin Forward PCR Primer
gactcatcgtactctcccttcg

SEQ ID NO: 153 - DNA, 22 bp, Artificial Sequence
  Actin Reverse PCR Primer
gactcatcgtactctcccttcg

SEQ ID NO: 154 - DNA, 20 bp, Artificial Sequence
  HPH Forward  PCR Primer
tgttggtggaagaggatacg

SEQ ID NO: 155 - DNA, 18 bp, Artificial Sequence
  HPH Reverse PCR Primer
atcagcagcagcgatagc

SEQ ID NO: 156 - DNA, 20 bp, Artificial Sequence
  1F  PCR Primer
atgtccactgggttcgtgcc

SEQ ID NO: 157 - DNA, 20 bp, Artificial Sequence
  1R   PCR Primer
gaagggaacttatccggtcc

SEQ ID NO: 158 - DNA, 20 bp, Artificial Sequence
  2F  PCR Primer
tgcgctgccattctccaaat

SEQ ID NO: 159 - DNA, 20 bp, Artificial Sequence
  2R  PCR Primer
accgagctcgaattcaattc

SEQ ID NO: 160 - DNA, 20 bp, Artificial Sequence
  3F  PCR Primer
cctgcattcggttaaacacc

SEQ ID NO: 161 - DNA, 20 bp, Artificial Sequence
  3R  PCR Primer
ccatctggcttctgccttgc

SEQ ID NO: 162 - DNA, 20 bp, Artificial Sequence
  4F  PCR Primer
attccgatccccagggcagt

SEQ ID NO: 163 - DNA, 20 bp, Artificial Sequence
  4R  PCR Primer
gccaacgttgcagccttgct

SEQ ID NO: 164 - DNA, 20 bp, Artificial Sequence
  5F  PCR Primer
gccctgggatgttgttaagt

SEQ ID NO: 165 - DNA, 20 bp, Artificial Sequence
  5R  PCR Primer
gtaacttaggacttgtgcga

SEQ ID NO: 166 - DNA, 19 bp, Artificial Sequence
  IPT-F   PCR Primer
tctctaccttgatgatcgg

SEQ ID NO: 167 - DNA, 20 bp, Artificial Sequence
  IPT-R  PCR Primer
aacatctgcttaactctggc

SEQ ID NO: 168 - DNA, 19 bp, Artificial Sequence
  dsRED-F  PCR Primer
atggcttcatctgagaacg

SEQ ID NO: 169 - DNA, 19 bp, Artificial Sequence
  dsRED-R   PCR Primer
ttccgtattggaattgagg

SEQ ID NO: 170 - DNA, 21 bp, Artificial Sequence
  PAT-F   PCR Primer
ttgcttaagtctatggaggcg

SEQ ID NO: 171 - DNA, 20 bp, Artificial Sequence
  PAT-R    PCR Primer
tgggtaactggcctaactgg

SEQ ID NO: 172 - DNA, 21 bp, Artificial Sequence
  ELP-F   PCR Primer
atgatatgtagacatagtggg

SEQ ID NO: 173 - DNA, 19 bp, Artificial Sequence
  ELP-R    PCR Primer
agggtgtaaggtactagcc

SEQ ID NO: 174 - DNA, 20 bp, Artificial Sequence
  Hph-F   PCR Primer
tgttggtggaagaggatacg

SEQ ID NO: 175 - DNA, 18 bp, Artificial Sequence
  Hph-R    PCR Primer
atcagcagcagcgatagc

SEQ ID NO: 176 - DNA, 24 bp, Artificial Sequence
  actin-F   PCR Primer
gtggagaagaactacgagctaccc

SEQ ID NO: 177 - DNA, 22 bp, Artificial Sequence
  actin-R    PCR Primer
gactcatcgtactctcccttcg

SEQ ID NO: 178 - protein, 7 aa, Artificial Sequence
  27961  Finger 1
RSDNLAR

SEQ ID NO: 179 - protein, 7 aa, Artificial Sequence
  27961  Finger 2
QKKDRSY

SEQ ID NO: 180 - protein, 7 aa, Artificial Sequence
  27961 Finger 3
RSDNLAR

SEQ ID NO: 181 - protein, 7 aa, Artificial Sequence
  27961  Finger 4
QRGNRNT

SEQ ID NO: 182 - protein, 7 aa, Artificial Sequence
  27961  Finger 5
RSDHLSR

SEQ ID NO: 183 - protein, 7 aa, Artificial Sequence
  27961  Finger 6
RNQDRTN

SEQ ID NO: 184 - protein, 7 aa, Artificial Sequence
  27962  Finger 1
DRSNLSR

SEQ ID NO: 185 - protein, 7 aa, Artificial Sequence
  27962  Finger 2
RQDSRSQ

SEQ ID NO: 186 - protein, 7 aa, Artificial Sequence
  27962  Finger 3
QSSDLSR

SEQ ID NO: 187 - protein, 7 aa, Artificial Sequence
  27962  Finger 4
DRSALAR

SEQ ID NO: 188 - protein, 7 aa, Artificial Sequence
  27962  Finger 5
TSGSLTR

SEQ ID NO: 189 - protein, 7 aa, Artificial Sequence
  27973  Finger 1
QSSDLSR

SEQ ID NO: 190 - protein, 7 aa, Artificial Sequence
  27973  Finger 2
AASNRSK

SEQ ID NO: 191 - protein, 7 aa, Artificial Sequence
  27973  Finger 3
TSGSLSR

SEQ ID NO: 192 - protein, 7 aa, Artificial Sequence
  27973  Finger 4
RSDALAR

SEQ ID NO: 193 - protein, 7 aa, Artificial Sequence
  27973   Finger 5
RSDVLST

SEQ ID NO: 194 - protein, 7 aa, Artificial Sequence
  27973  Finger 6
WGRLRKL

SEQ ID NO: 195 - protein, 7 aa, Artificial Sequence
  27974  Finger 1
ERGTLAR

SEQ ID NO: 196 - protein, 7 aa, Artificial Sequence
  27974  Finger 2
RSDDLTR

SEQ ID NO: 197 - protein, 7 aa, Artificial Sequence
  27974  Finger 3
RSDHLSA

SEQ ID NO: 198 - protein, 7 aa, Artificial Sequence
  27974  Finger 4
QHGALQT

SEQ ID NO: 199 - protein, 7 aa, Artificial Sequence
  27974 Finger 5
TSGNLTR

SEQ ID NO: 200 - protein, 7 aa, Artificial Sequence
  27974  Finger 6
QSGHLSR

SEQ ID NO: 201 - protein, 7 aa, Artificial Sequence
  27987  Finger 1
TSGSLTR

SEQ ID NO: 202 - protein, 7 aa, Artificial Sequence
  27987  Finger 2
RSDHLSQ

SEQ ID NO: 203 - protein, 7 aa, Artificial Sequence
  27987  Finger 3
CTRNRWR

SEQ ID NO: 204 - protein, 7 aa, Artificial Sequence
  27987  Finger 4
RSDNLSE

SEQ ID NO: 205 - protein, 7 aa, Artificial Sequence
  27987  Finger 5
ASKTRKN

SEQ ID NO: 206 - protein, 7 aa, Artificial Sequence
  27990 Finger 1
TSGSLSR

SEQ ID NO: 207 - protein, 7 aa, Artificial Sequence
  27990 Finger 2
TSSNRAV

SEQ ID NO: 208 - protein, 7 aa, Artificial Sequence
  27990 Finger 3
TSGNLTR

SEQ ID NO: 209 - protein, 7 aa, Artificial Sequence
  27990 Finger 4
DRSALAR

SEQ ID NO: 210 - protein, 7 aa, Artificial Sequence
  27990  Finger 5
RSDVLSE

SEQ ID NO: 211 - protein, 7 aa, Artificial Sequence
  27990 Finger 6
RNFSLTM

SEQ ID NO: 212 - protein, 7 aa, Artificial Sequence
  27991 Finger 1
QSGDLTR

SEQ ID NO: 213 - protein, 7 aa, Artificial Sequence
  27991 Finger 2
TSGSLSR

SEQ ID NO: 214 - protein, 7 aa, Artificial Sequence
  27991 Finger 3
QSGNLAR

SEQ ID NO: 215 - protein, 7 aa, Artificial Sequence
  27991 Finger 4
TSGSLSR

SEQ ID NO: 216 - protein, 7 aa, Artificial Sequence
  27991 Finger 5
QSGSLTR

SEQ ID NO: 217 - protein, 7 aa, Artificial Sequence
  27992 Finger 1
DRSHLAR

SEQ ID NO: 218 - protein, 7 aa, Artificial Sequence
  27992 Finger 2
TSGSLSR

SEQ ID NO: 219 - protein, 7 aa, Artificial Sequence
  27992 Finger 3
TSSNRAV

SEQ ID NO: 220 - protein, 7 aa, Artificial Sequence
  27992 Finger 4
TSGNLTR

SEQ ID NO: 221 - protein, 7 aa, Artificial Sequence
  27992 Finger 5
DRSALAR

SEQ ID NO: 222 - protein, 7 aa, Artificial Sequence
  28004 Finger 1
QSGNLAR

SEQ ID NO: 223 - protein, 7 aa, Artificial Sequence
  28004  Finger 2
HLGNLKT

SEQ ID NO: 224 - protein, 7 aa, Artificial Sequence
  28004  Finger 3
RSDHLSQ

SEQ ID NO: 225 - protein, 7 aa, Artificial Sequence
  28004  Finger 4
TARLLKL

SEQ ID NO: 226 - protein, 7 aa, Artificial Sequence
  28004 Finger5
QSGNLAR

SEQ ID NO: 227 - protein, 7 aa, Artificial Sequence
  28004 Finger 6
QTSHLPQ

SEQ ID NO: 228 - protein, 7 aa, Artificial Sequence
  28005 Finger 1
RSDNLSV

SEQ ID NO: 229 - protein, 7 aa, Artificial Sequence
  28005 Finger 2
TSGHLSR

SEQ ID NO: 230 - protein, 7 aa, Artificial Sequence
  28005 Finger 3
TSGSLTR

SEQ ID NO: 231 - protein, 7 aa, Artificial Sequence
  28005 Finger 4
RSDALST

SEQ ID NO: 232 - protein, 7 aa, Artificial Sequence
  28005 Finger 5
DRSTRTK

SEQ ID NO: 233 - protein, 7 aa, Artificial Sequence
  28021 Finger 1
QNAHRKT

SEQ ID NO: 234 - protein, 7 aa, Artificial Sequence
  28021 Finger 2
TSGNLTR

SEQ ID NO: 235 - protein, 7 aa, Artificial Sequence
  28021 Finger 3
LKQMLAV

SEQ ID NO: 236 - protein, 7 aa, Artificial Sequence
  28021 Finger 4
RSDNLSR

SEQ ID NO: 237 - protein, 7 aa, Artificial Sequence
  28021 Finger 5
DNSNRKT

SEQ ID NO: 238 - protein, 7 aa, Artificial Sequence
  28022 Finger 1
RSDNLSV

SEQ ID NO: 239 - protein, 7 aa, Artificial Sequence
  28022 Finger 2
QNANRIT

SEQ ID NO: 240 - protein, 7 aa, Artificial Sequence
  28022 Finger 3
TSGSLSR

SEQ ID NO: 241 - protein, 7 aa, Artificial Sequence
  28022 Finger 4
QSSVRNS

SEQ ID NO: 242 - protein, 7 aa, Artificial Sequence
  28022 Finger 5
DRSALAR

SEQ ID NO: 243 - protein, 7 aa, Artificial Sequence
  28023 Finger 1
RSDNLSR

SEQ ID NO: 244 - protein, 7 aa, Artificial Sequence
  28023 Finger 2
DNSNRKT

SEQ ID NO: 245 - protein, 7 aa, Artificial Sequence
  28023 Finger 3
DRSNLTR

SEQ ID NO: 246 - protein, 7 aa, Artificial Sequence
  28023 Finger 4
RSDVLSE

SEQ ID NO: 247 - protein, 7 aa, Artificial Sequence
  28023 Finger 5
TRNGLKY

SEQ ID NO: 248 - protein, 7 aa, Artificial Sequence
  28024 Finger 1
RSDALAR

SEQ ID NO: 249 - protein, 7 aa, Artificial Sequence
  28024 Finger 2
RSDVLSE

SEQ ID NO: 250 - protein, 7 aa, Artificial Sequence
  28024 finger 3
RSSDRTK

SEQ ID NO: 251 - protein, 7 aa, Artificial Sequence
  28024 Finger 4
RSDNLSV

SEQ ID NO: 252 - protein, 7 aa, Artificial Sequence
  28024 Finger 5
QNANRIT

SEQ ID NO: 253 - protein, 7 aa, Artificial Sequence
  28025 Finger 1
QSSDLSR

SEQ ID NO: 254 - protein, 7 aa, Artificial Sequence
  28025 Finger 2
QSTHRNA

SEQ ID NO: 255 - protein, 7 aa, Artificial Sequence
  28025 Finger 3
RSDNLAR

SEQ ID NO: 256 - protein, 7 aa, Artificial Sequence
  28025 Finger 4
QRGNRNT

SEQ ID NO: 257 - protein, 7 aa, Artificial Sequence
  28025 Finger 5
RSDHLSR

SEQ ID NO: 258 - protein, 7 aa, Artificial Sequence
  28025 Finger 6
RNQDRTN

SEQ ID NO: 259 - protein, 7 aa, Artificial Sequence
  28026 Finger 1
DRSNLSR

SEQ ID NO: 260 - protein, 7 aa, Artificial Sequence
  28026 Finger 2
RQDSRSQ

SEQ ID NO: 261 - protein, 7 aa, Artificial Sequence
  28026 Finger 3
QSSDLSR

SEQ ID NO: 262 - protein, 7 aa, Artificial Sequence
  28026 Finger 4
DRSALAR

SEQ ID NO: 263 - protein, 7 aa, Artificial Sequence
  28026 Finger 5
TSGSLTR

SEQ ID NO: 264 - protein, 7 aa, Artificial Sequence
  28035 Finger 1
QSSDLSR

SEQ ID NO: 265 - protein, 7 aa, Artificial Sequence
  28035 Finger 2
AASNRSK

SEQ ID NO: 266 - protein, 7 aa, Artificial Sequence
  28035 Finger 3
TSGSLSR

SEQ ID NO: 267 - protein, 7 aa, Artificial Sequence
  28035 Finger 4
RSDALAR

SEQ ID NO: 268 - protein, 7 aa, Artificial Sequence
  28035 Finger 5
RSDTLSQ

SEQ ID NO: 269 - protein, 7 aa, Artificial Sequence
  28035 Finger 6
QRDHRIK

SEQ ID NO: 270 - protein, 7 aa, Artificial Sequence
  28036 Finger 1
RSDDLTR

SEQ ID NO: 271 - protein, 7 aa, Artificial Sequence
  28036 Finger 2
QSSDLRR

SEQ ID NO: 272 - protein, 7 aa, Artificial Sequence
  28036 Finger 3
RSDHLSA

SEQ ID NO: 273 - protein, 7 aa, Artificial Sequence
  28036 Finger 4
QHGALQT

SEQ ID NO: 274 - protein, 7 aa, Artificial Sequence
  28036 Finger 5
TSGNLTR

SEQ ID NO: 275 - protein, 7 aa, Artificial Sequence
  28036 Finger 6
QSGHLSR

SEQ ID NO: 276 - protein, 7 aa, Artificial Sequence
  28039 Finger 1
TSGSLSR

SEQ ID NO: 277 - protein, 7 aa, Artificial Sequence
  28039 Finger 2
RSDALAR

SEQ ID NO: 278 - protein, 7 aa, Artificial Sequence
  28039 Finger 3
RSDTLSQ

SEQ ID NO: 279 - protein, 7 aa, Artificial Sequence
  28039 Finger 4
QRDHRIK

SEQ ID NO: 280 - protein, 7 aa, Artificial Sequence
  28039 Finger 5
TSGNLTR

SEQ ID NO: 281 - protein, 7 aa, Artificial Sequence
  28039 FInger 6
DRGDLRK

SEQ ID NO: 282 - protein, 7 aa, Artificial Sequence
  28040 Finger 1
DSSDRKK

SEQ ID NO: 283 - protein, 7 aa, Artificial Sequence
  28040 Finger 2
TSGNLTR

SEQ ID NO: 284 - protein, 7 aa, Artificial Sequence
  28040 Finger 3
DNYNRAK

SEQ ID NO: 285 - protein, 7 aa, Artificial Sequence
  28040 Finger 4
DRSHLTR

SEQ ID NO: 286 - protein, 7 aa, Artificial Sequence
  28040 Finger 5
RSDNLTT

SEQ ID NO: 287 - protein, 7 aa, Artificial Sequence
  28051 Finger 1
RSDNLSN

SEQ ID NO: 288 - protein, 7 aa, Artificial Sequence
  28051 Finger 2
TSSSRIN

SEQ ID NO: 289 - protein, 7 aa, Artificial Sequence
  28051 Finger 3
RSDNLSE

SEQ ID NO: 290 - protein, 7 aa, Artificial Sequence
  28051 Finger 4
ASKTRKN

SEQ ID NO: 291 - protein, 7 aa, Artificial Sequence
  28051 Finger 5
RSDALTQ

SEQ ID NO: 292 - protein, 7 aa, Artificial Sequence
  28052 Finger 1
RSDTLST

SEQ ID NO: 293 - protein, 7 aa, Artificial Sequence
  28052 Finger 2
DRSSRIK

SEQ ID NO: 294 - protein, 7 aa, Artificial Sequence
  28052 Finger 3
RSDDLSK

SEQ ID NO: 295 - protein, 7 aa, Artificial Sequence
  28052 Finger 4
DNSNRIK

SEQ ID NO: 296 - protein, 7 aa, Artificial Sequence
  28053 Finger 1
QSSDLSR

SEQ ID NO: 297 - protein, 7 aa, Artificial Sequence
  28053 Finger 2
QAGNLSK

SEQ ID NO: 298 - protein, 7 aa, Artificial Sequence
  28053 Finger 3
QSGDLTR

SEQ ID NO: 299 - protein, 7 aa, Artificial Sequence
  28053 Finger 4
TSGSLSR

SEQ ID NO: 300 - protein, 7 aa, Artificial Sequence
  28053 Finger 5
QSGNLAR

SEQ ID NO: 301 - protein, 7 aa, Artificial Sequence
  28054 Finger 1
TSGSLSR

SEQ ID NO: 302 - protein, 7 aa, Artificial Sequence
  28054 Finger 2
LRQTLRD

SEQ ID NO: 303 - protein, 7 aa, Artificial Sequence
  28054 Finger 3
TSGNLTR

SEQ ID NO: 304 - protein, 7 aa, Artificial Sequence
  28054 Finger 4
DRSALAR

SEQ ID NO: 305 - protein, 7 aa, Artificial Sequence
  28054 Finger 5
RSDVLSE

SEQ ID NO: 306 - protein, 7 aa, Artificial Sequence
  28054 Finger 6
RNFSLTM

SEQ ID NO: 307 - protein, 7 aa, Artificial Sequence
  28055 Finger 1
QSGDLTR

SEQ ID NO: 308 - protein, 7 aa, Artificial Sequence
  28055 Finger 2
TSGSLSR

SEQ ID NO: 309 - protein, 7 aa, Artificial Sequence
  28055 Finger 3
QSGNLAR

SEQ ID NO: 310 - protein, 7 aa, Artificial Sequence
  28055 Finger 4
TSGSLSR

SEQ ID NO: 311 - protein, 7 aa, Artificial Sequence
  28055 Finger 5
QSGSLTR

SEQ ID NO: 312 - protein, 7 aa, Artificial Sequence
  28056 Finger 1
DRSHLAR

SEQ ID NO: 313 - protein, 7 aa, Artificial Sequence
  28056 Finger 2
TSGSLSR

SEQ ID NO: 314 - protein, 7 aa, Artificial Sequence
  28056 Finger 3
LRQTLRD

SEQ ID NO: 315 - protein, 7 aa, Artificial Sequence
  28056 Finger 4
TSGNLTR

SEQ ID NO: 316 - protein, 7 aa, Artificial Sequence
  28056 Finger 5
DRSALAR

SEQ ID NO: 317 - protein, 7 aa, Artificial Sequence
  24800 Finger 1
RSDNLST

SEQ ID NO: 318 - protein, 7 aa, Artificial Sequence
  24800 Finger 2
HSHARIK

SEQ ID NO: 319 - protein, 7 aa, Artificial Sequence
  24800 Finger 3
HRSSLRR

SEQ ID NO: 320 - protein, 7 aa, Artificial Sequence
  24800 Finger 4
RSDHLSE

SEQ ID NO: 321 - protein, 7 aa, Artificial Sequence
  24800 Finger 5
QNANRIT

SEQ ID NO: 322 - protein, 7 aa, Artificial Sequence
  24801 Finger 1
DRSNLSR

SEQ ID NO: 323 - protein, 7 aa, Artificial Sequence
  24801 Finger 2
HRSSLRR

SEQ ID NO: 324 - protein, 7 aa, Artificial Sequence
  24801 Finger 3
TSGNLTR

SEQ ID NO: 325 - protein, 7 aa, Artificial Sequence
  24801 Finger 4
MSHHLRD

SEQ ID NO: 326 - protein, 7 aa, Artificial Sequence
  24801 Finger 5
DQSNLRA

SEQ ID NO: 327 - protein, 7 aa, Artificial Sequence
  24794 finger 1
QSGNLAR

SEQ ID NO: 328 - protein, 7 aa, Artificial Sequence
  24794 Finger 2
RSDNLSR

SEQ ID NO: 329 - protein, 7 aa, Artificial Sequence
  24794 Finger 3
DNNARIN

SEQ ID NO: 330 - protein, 7 aa, Artificial Sequence
  24794 Finger 4
DRSNLSR

SEQ ID NO: 331 - protein, 7 aa, Artificial Sequence
  24794 Finger 5
RSDHLTQ

SEQ ID NO: 332 - protein, 7 aa, Artificial Sequence
  24795 Finger 1
RSDNLRE

SEQ ID NO: 333 - protein, 7 aa, Artificial Sequence
  24795 Finger 2
QSGALAR

SEQ ID NO: 334 - protein, 7 aa, Artificial Sequence
  24795 Finger 3
QSGNLAR

SEQ ID NO: 335 - protein, 7 aa, Artificial Sequence
  24795 Finger 4
RSDVLSE

SEQ ID NO: 336 - protein, 7 aa, Artificial Sequence
  24795 Finger 5
SPSSRRT

SEQ ID NO: 337 - protein, 7 aa, Artificial Sequence
  24810 Finger 1
RSDSLSR

SEQ ID NO: 338 - protein, 7 aa, Artificial Sequence
  24810 Finger 2
RKDARIT

SEQ ID NO: 339 - protein, 7 aa, Artificial Sequence
  24810 Finger 3
RSDHLSA

SEQ ID NO: 340 - protein, 7 aa, Artificial Sequence
  24810 Finger 4
WSSSLYY

SEQ ID NO: 341 - protein, 7 aa, Artificial Sequence
  24810 Finger 5
NSRNLRN

SEQ ID NO: 342 - protein, 7 aa, Artificial Sequence
  24811 Finger 1
DQSTLRN

SEQ ID NO: 343 - protein, 7 aa, Artificial Sequence
  24811  Finger 2
DRSNLSR

SEQ ID NO: 344 - protein, 7 aa, Artificial Sequence
  24811 Finger 3
DRSNLWR

SEQ ID NO: 345 - protein, 7 aa, Artificial Sequence
  24811 Finger 4
DRSALSR

SEQ ID NO: 346 - protein, 7 aa, Artificial Sequence
  24811 Finger 5
RSDALAR

SEQ ID NO: 347 - protein, 7 aa, Artificial Sequence
  24814 Finger 1
RSDALSR

SEQ ID NO: 348 - protein, 7 aa, Artificial Sequence
  24814 Finger 2
DRSDLSR

SEQ ID NO: 349 - protein, 7 aa, Artificial Sequence
  24814 Finger 3
RSDHLTQ

SEQ ID NO: 350 - protein, 7 aa, Artificial Sequence
  24814  Finger 4
QSGALAR

SEQ ID NO: 351 - protein, 7 aa, Artificial Sequence
  24814  Finger 5
QSGNLAR

SEQ ID NO: 352 - protein, 7 aa, Artificial Sequence
  24815 Finger 1
DRSNLSR

SEQ ID NO: 353 - protein, 7 aa, Artificial Sequence
  24815  Finger 2
DSSARNT

SEQ ID NO: 354 - protein, 7 aa, Artificial Sequence
  24815  Finger 3
DRSSRKR

SEQ ID NO: 355 - protein, 7 aa, Artificial Sequence
  24815  Finger 4
QSGDLTR

SEQ ID NO: 356 - protein, 7 aa, Artificial Sequence
  24815  Finger 5
LAHHLVQ

SEQ ID NO: 357 - protein, 7 aa, Artificial Sequence
  24818  Finger 1
RSDNLST

SEQ ID NO: 358 - protein, 7 aa, Artificial Sequence
  24818  Finger 2
HSHARIK

SEQ ID NO: 359 - protein, 7 aa, Artificial Sequence
  24818  Finger 3
TSGHLSR

SEQ ID NO: 360 - protein, 7 aa, Artificial Sequence
  24818 Finger 4
RSDNLSV

SEQ ID NO: 361 - protein, 7 aa, Artificial Sequence
  24818  Finger 5
IRSTLRD

SEQ ID NO: 362 - protein, 7 aa, Artificial Sequence
  24819 Finger 1
TSGHLSR

SEQ ID NO: 363 - protein, 7 aa, Artificial Sequence
  24819 Finger 2
DRSNLSR

SEQ ID NO: 364 - protein, 7 aa, Artificial Sequence
  24819 Finger 3
HRSSLRR

SEQ ID NO: 365 - protein, 7 aa, Artificial Sequence
  24819 Finger 4
TSGNLTR

SEQ ID NO: 366 - protein, 7 aa, Artificial Sequence
  24819 Finger 5
MSHHLRD

SEQ ID NO: 367 - protein, 7 aa, Artificial Sequence
  24796 Finger 1
RSDALSR

SEQ ID NO: 368 - protein, 7 aa, Artificial Sequence
  24796 finger 2
DRSDLSR

SEQ ID NO: 369 - protein, 7 aa, Artificial Sequence
  24796 Finger 3
RSDHLTQ

SEQ ID NO: 370 - protein, 7 aa, Artificial Sequence
  24796 Finger 4
QSGALAR

SEQ ID NO: 371 - protein, 7 aa, Artificial Sequence
  24796 Finger 5
QSGNLAR

SEQ ID NO: 372 - protein, 7 aa, Artificial Sequence
  24797 Finger 1
RSAVLSE

SEQ ID NO: 373 - protein, 7 aa, Artificial Sequence
  24797 Finger 2
TNSNRIT

SEQ ID NO: 374 - protein, 7 aa, Artificial Sequence
  24797 Finger 3
LKQHLNE

SEQ ID NO: 375 - protein, 7 aa, Artificial Sequence
  24797 Finger 4
QSGALAR

SEQ ID NO: 376 - protein, 7 aa, Artificial Sequence
  24797 Finger 5
QSGNLAR

SEQ ID NO: 377 - protein, 7 aa, Artificial Sequence
  24836 Finger 1
DRSNLSR

SEQ ID NO: 378 - protein, 7 aa, Artificial Sequence
  24836 Finger 2
QSGDLTR

SEQ ID NO: 379 - protein, 7 aa, Artificial Sequence
  24836 Finger 3
QSGALAR

SEQ ID NO: 380 - protein, 7 aa, Artificial Sequence
  24836 Finger 4
DRSNLSR

SEQ ID NO: 381 - protein, 7 aa, Artificial Sequence
  24836 Finger 5
QRTHLTQ

SEQ ID NO: 382 - protein, 7 aa, Artificial Sequence
  24837 Finger 1
RSDNLSN

SEQ ID NO: 383 - protein, 7 aa, Artificial Sequence
  24837 Finger 2
TNSNRIK

SEQ ID NO: 384 - protein, 7 aa, Artificial Sequence
  24837 Finger 3
QSSDLSR

SEQ ID NO: 385 - protein, 7 aa, Artificial Sequence
  24837 Finger 4
QSSDLRR

SEQ ID NO: 386 - protein, 7 aa, Artificial Sequence
  24837 Finger 5
DRSNRIK

SEQ ID NO: 387 - protein, 7 aa, Artificial Sequence
  24844 Finger 1
RSANLAR

SEQ ID NO: 388 - protein, 7 aa, Artificial Sequence
  24844 Finger 2
RSDNLTT

SEQ ID NO: 389 - protein, 7 aa, Artificial Sequence
  24844 Finger 3
QSGELIN

SEQ ID NO: 390 - protein, 7 aa, Artificial Sequence
  24844 Finger 4
RSADLSR

SEQ ID NO: 391 - protein, 7 aa, Artificial Sequence
  24844 Finger 5
RSDNLSE

SEQ ID NO: 392 - protein, 7 aa, Artificial Sequence
  24844 Finger 6
DRSHLAR

SEQ ID NO: 393 - protein, 7 aa, Artificial Sequence
  24845 Finger 1
DRSHLAR

SEQ ID NO: 394 - protein, 7 aa, Artificial Sequence
  24845 Finger 2
RSDNLSE

SEQ ID NO: 395 - protein, 7 aa, Artificial Sequence
  24845 Finger 3
SKQYLIK

SEQ ID NO: 396 - protein, 7 aa, Artificial Sequence
  24845 Finger 4
ERGTLAR

SEQ ID NO: 397 - protein, 7 aa, Artificial Sequence
  24845 Finger 5
RSDHLTT

SEQ ID NO: 398 - protein, 7 aa, Artificial Sequence
  24820 Finger 1
QSGALAR

SEQ ID NO: 399 - protein, 7 aa, Artificial Sequence
  24820 Finger 2
QSGNLAR

SEQ ID NO: 400 - protein, 7 aa, Artificial Sequence
  24820 Finger 3
DRSHLAR

SEQ ID NO: 401 - protein, 7 aa, Artificial Sequence
  24820 Finger 4
DRSDLSR

SEQ ID NO: 402 - protein, 7 aa, Artificial Sequence
  24820 Finger 5
RSDNLTR

SEQ ID NO: 403 - protein, 7 aa, Artificial Sequence
  24821 Finger 1
DRSHLAR

SEQ ID NO: 404 - protein, 7 aa, Artificial Sequence
  24821 Finger 2
RSDNLSE

SEQ ID NO: 405 - protein, 7 aa, Artificial Sequence
  24821 Finger 3
SKQYLIK

SEQ ID NO: 406 - protein, 7 aa, Artificial Sequence
  24821 Finger 4
ERGTLAR

SEQ ID NO: 407 - protein, 7 aa, Artificial Sequence
  24821 Finger 5
RSDHLTT

SEQ ID NO: 408 - protein, 7 aa, Artificial Sequence
  24828 Finger 1
DRSDLSR

SEQ ID NO: 409 - protein, 7 aa, Artificial Sequence
  24828 Finger 2
RSDNLTR

SEQ ID NO: 410 - protein, 7 aa, Artificial Sequence
  24828 Finger 3
QRTHLTQ

SEQ ID NO: 411 - protein, 7 aa, Artificial Sequence
  24828 Finger 4
RSDNLSE

SEQ ID NO: 412 - protein, 7 aa, Artificial Sequence
  24828 Finger 5
ASKTRKN

SEQ ID NO: 413 - protein, 7 aa, Artificial Sequence
  24829 Finger 1
RSDTLSE

SEQ ID NO: 414 - protein, 7 aa, Artificial Sequence
  24829 Finger 2
QSHNRTK

SEQ ID NO: 415 - protein, 7 aa, Artificial Sequence
  24829 Finger 3
QSDHLTQ

SEQ ID NO: 416 - protein, 7 aa, Artificial Sequence
  24829 Finger 4
RSSDLSR

SEQ ID NO: 417 - protein, 7 aa, Artificial Sequence
  24829 Finger 5
QSSDLSR

SEQ ID NO: 418 - protein, 7 aa, Artificial Sequence
  24829 Finger 6
RSDHLTQ

SEQ ID NO: 419 - protein, 7 aa, Artificial Sequence
  24832 Finger 1
RSDSLSR

SEQ ID NO: 420 - protein, 7 aa, Artificial Sequence
  24832 Finger 2
RKDARIT

SEQ ID NO: 421 - protein, 7 aa, Artificial Sequence
  24832 Finger 3
DRSHLSR

SEQ ID NO: 422 - protein, 7 aa, Artificial Sequence
  24832 Finger 4
QSGNLAR

SEQ ID NO: 423 - protein, 7 aa, Artificial Sequence
  24832 Finger 5
QSSDLSR

SEQ ID NO: 424 - protein, 7 aa, Artificial Sequence
  24832 Finger 6
DRSALAR

SEQ ID NO: 425 - protein, 7 aa, Artificial Sequence
  24833 Finger 1
RSDDLSK

SEQ ID NO: 426 - protein, 7 aa, Artificial Sequence
  24833 Finger 2
RSDTRKT

SEQ ID NO: 427 - protein, 7 aa, Artificial Sequence
  24833 Finger 3
DRSNLSR

SEQ ID NO: 428 - protein, 7 aa, Artificial Sequence
  24833 Finger 4
DRSNLWR

SEQ ID NO: 429 - protein, 7 aa, Artificial Sequence
  24833 Finger 5
RSDSLSR

SEQ ID NO: 430 - protein, 7 aa, Artificial Sequence
  24833 Finger 6
NNDHRKT

SEQ ID NO: 431 - DNA, 694 bp, artificial sequence
  Event details: em02-5788-1-1 Left border flanking
tcgagattgtgctgaagtaaaccattttacttcaaatctatttttaactatttacttttattaaggagagaaactttgctgattaattcaaattagtgatcattaagattccaaagattccgatttagaaaagtcaaagattcaaagaacaagtctaggtcctcatggctcatgttgcatccgattcaccatccactcatctttcatatcttcctccactgtctctctagaaacaactcatttaatttagaaaactcctttttcaatttagaaatattaaagtttatcacaatgtatcaattaaatattatccgatgactcattcatagtcaggaccttgctgtctgtgtcgtccgtaattattatttcaatacaaaacaaatatatgttcactcagaaaattacggcgcaatcatctaattttgtggaccaaaataaatagcgtagcttcgagatttcaaagttgtgttcaaatttaattttgatttccgttcctcgtatactcttttatgtatagaaaataataatatccactactagtagttgataactacattacatatattaaaattatgatgtcacattgcggacgtttttaatgtactgaattaacgccgaattgaattcgagctcggtacccggggatcctctagagtcgacctgcaggcatgcaagcttagcttgagcttggatc

SEQ ID NO: 432 - DNA, 732 bp, artificial sequence
  em02-5788-1-1 Left border flanking
cataaccaccatctcaaacaatagaacttcctaagtgaagcaatgacttcaaatctacttgaaggcatggagtataagccatgttcctttcagaggggactgtacttctgtagattactttccctcattaaccagatctggccggcctacccagctttcttgtacacatagcgaccgagctcgagccgaagttcggtcgctgtttcactgtttgggaaagcatcagtaacgcagaagacataattaaaaattaattatatatggtagtttttctagattctccactatacctcattgtgattgaaaaacaactatatatatatatatatatgtatttaaaattaagaaatcattaaatcgtaccataatgcagaaaactttataagttcctattcttttgtcaagatgagtagatgacacatcatgtaccacataacataaccataatggtgcgataccataccaaaacttaatttagaaactaattaaaattttggtagtttaagattcctcctaatggttgtcaaaaaaaaaaaaagattcctcctaatacatggtagaatatatttttgagttaaaatgaaagtaaaatcttcaaattagtcataaggaaattctaaaaaacatcgactttctttataaagatcccattgtaattttagatgattaattttatcccaatccaattaagaattgtacacatcggcctctatatatatcaaacacctaaaa

SEQ ID NO: 433 - DNA, 643 bp, artificial sequence
  Event details: ad58-5784-2-1 Left border flanking
cgatttgcagctataatcaatcacaccttatcgttctttcaaagaaaaatcgaaagttgtaaactttatcagcctgtgtagtgattatttcaatttgataaagaaaaaaaaaggcttagctttatttggttttttgttacaatcttgattaattttagattagcactctgattctagcggaacatgagagtggttccatcaaacctcagacagtgagcacagtggttgcagcaaaccatttgggtgagagctcttcagtttctttgctattagctggttctggctcttctcttcaagaagctgcttctcaagctgcctcttgtcatccttctgtttccgaggtaactaactacattcttcatttgtccttttttcttgtgggtcttaaatgttygtgcttttctttataggtacttgttgctgattcagatagatttgagtaccctttagctgaaccttgggctaaactggttgactttgttcgccaacaaagagattactctcacatccttgccttcctctagctcatttggcaagaacatacttcctctagacaacttaataacacattgcggacgtttttaatgtactgaattaacgccgaattgaattcgagctcggtacccggggatcctctagagtc

SEQ ID NO: 434 - DNA, 653 bp, artificial sequence
  ad58-5784-2-1 Right border flanking
cctgtcataaccaccatctcaaacaatagaacttcctaagtgaagcaatgacttcaaatctacttgaaggcatggagtataagccatgttcctttcagaggggactgtacttctgtagattactttccctcattaaccagatctggccggcctacccagctttcttgtacaaagtggtgataaactatcgccggcctacctcgcgttgctgctcttttagatgtctctcctgttactgatgttgtcaaaatcttaggatccaatgagtttatcaggtatacttctatcatgtattgcttgagattttggagtgttagtaaagatttcaataaaagaattttttcaaacaaaattttgggggcttgaagctaatgtttggaaatatgtaacggagtttaaatcttttggcaggcctatatatgcgggaaacgccttgtgtagagttcgctatactggtgctggtccttgtgtgttgactattagaactacatcttttcctgttaccccaataactgagtcaaagaaagctactatctctcagattgatctctcgaaattcaaagaaggtttgtttagtattattctcttgtgcatagcctttttgctttttttttttttataaaaaaagttgagtatgcttattgcccattgca

SEQ ID NO: 435 - DNA, 450 bp, artificial sequence
  Event details: ad58-5898-10-1  Left border flanking
taatttcattttcgtcattttggtaaagtaacaaaagacagaatattggttagtcgtgttggttaggaataaaataaagaacgtggacatcgtggaataaaaatattcagacaaggaaactaacaataaaacagtaatgaacatggttctgaatctcatctttgtgtatctccaatggaatccaccgccacgaatcagactccttctccaagctccaccgtcgacgatgacaatggcgacggtgtctataccgacgaatttaccaaactacccccggacccggggatcctctagagtcaacaaattgacgcttagacaacttaataacacattgcggacgtttttaatgtactgaattaacgccgaattgaattcgagctcggtacccggggatcctctagagtcgacctgcaggcatgcaagcttagcttgagcttggatcagattgtc

SEQ ID NO: 436 - DNA, 644 bp, artificial sequence
  ad58-5898-10-1   Right border flanking
cggcctacccagctttcttgtacaaagtggtgataaactatcagtgtttgattaaagataaaatttgatttttcattacataataatccattaattttcacgcacgtggaacccatttggtgtacttccacgtcctctaagagagcactgacccactcatcaaaaagatacatctttataagccccttcatcgtcacacagacacacacttccctctcaattattccatattctcctaatttctaattgttacacctcaacacattagattcgtaccaaacaaaaacgattagctcccaagcctaagcttttatttccttataatttttcttgggtttctctctataaagaatgcaaatgactgagagaggccgagccatgtggcacacgtccctagcctcggcattccgcacagctctagcttgcacaatcgttggtgcggctacgctctacggacccgagtggatcctccgttttgtggcattcccggcgttttcttacgtcacggtcattctcatcattacggacgccacgctaggcgacacactacgtggctgctggctagccctttacgccacatgtcagagcgttgcaccggctatcattacactaaggcttataggaccagctcggctcacggccgg

SEQ ID NO: 437 - DNA, 674 bp, artificial sequence
  lf31-6139-2-3 Left border flanking
tttctttccatcagttcttcggcaccttcctggctctgcgtctatctttctttccatcccggcccatctcgtacacattccacccaactacacaaacacgttatagtcttttacattatgaccaaatcaaccctaaagatacagcctttataaaaaatataggggtcaaagcaaagaagagaaagtttgcttacagtgtggagaaaagaagttggaagatgaggagtaagaagaagaagagaagagaaagggtcttctgatgaggaataggagataaggtggaactggaatgtttgccgctaaatacttgaagacaagagcttgattttcaagctcttcccattgtgactcagtgaaagggatcctagtcgtcatgaagagatagagaaaattgatgatgaaggaggtctgatgaagagaagagagagagagagatattacacaaagagggttgtattgcaaaattgaaagtgtagagagagtagtaggtaagtttttattaataatgttgttcacacctgcagtctgcagaatattgtggtgtgaacaaattgacgcttagacaacttaataacacattgcggacgtttttaatgtactgaattaacgccgaattgaattcgagctcggtacccggggatcctctagagtcgacctgcaggcatgcaagctta

SEQ ID NO: 438 - DNA, 544 bp, artificial sequence
  [00213]	lf31-6139-2-3  Right border flanking
ttcaatctacttgaaggcatggagtataagccatgttcctttcagaggggactgtacttctgtagattactttccctcattaaccagatctggccggcctacccagctttcttgtacaaagtggtgataaactatcagtgtttgaacatatatatacgcataatattctcagaacccgacccattggttgactcggatcaagatcgacccgatccgacccggttaaaagcacgtcgtctcctttggttcgccccttatattcgacgagtgagttcgattggatcgctgtttgtcatttctcactaccttaagaaaaaaaaaaaggtgcgtctctctctcacctttaccgctcacttacctctcagatctgacatcgattttccaaatcttctccaggtactctctctcctggccgttgacggtcccgtcccggccgtggatctgatttcgccgcgatctgaggtcaagcatggcggcagctaacgcccccatcacgatgaaggaggtcctaacggtgagtcccgcctccatttttagtaacata

SEQ ID NO: 439 - DNA, 569 bp, artificial sequence
  bm56-6315-1-1 Left border flanking
tacatcgcgattcatcctggtttgattagaatgacgaggaagttgtcatattcccaaacaggaaaattgggatcgccttatttgaaagtgggataacttcttcatcttaattcttatgagaattattccacttcctggtgattctccactactttttgtatataaatacagcttcttacatcgcgattcatcctgatttgattagaatgacgagaaagttgtcatattcccaaacaggaaaactgggatcacctgatttgaaagtgggataacttcttcatcctaattcttatgagatttattccacttcctggtgattctccacttctttatgtatccaaatacatcttcttacatcgcgattcatcctggtttgattagaatgacgaggaagttgtcatattcccaaacatgaaaactgggaaagtgggattgacgcttagacaacttaataacacattgcggacgtttttaatgtactgaattaacgccgaattgaattcgagctcggtacccggggatcctctagagtcgacctgcaggcatgcaagcttagcttgagcttggat

SEQ ID NO: 440 - DNA, 685 bp, artificial sequence
  bm56-6315-1-1  Right border flanking
ccaccatctcaaacaatagaacttcctaagtgaagcaatgacttcaaatctacttgaaggcatggagtataagccatgttcctttcagaggggactgtacttctgtagattactttccctcattaaccagatctggccggcctacccagctttcttgtacaaagtgacgataaactatcagtctttcaaagcgcatctatggctagtcatcacggtttttaactgttttacgaagtcgcggagaggctcgtcttctccctaggataaactgcagaggtcgacatcggaggtttctcgatctatgaacatagagtactgtttgagaaactccgaggcgagttggcggaaactccctatagagtttttctttagacaagagaaccactcaagcgctgcttcgcggaggttctcgacgaagaggcggcattcgccggcatctctttctctatctttaaacttggctcttcccatcgcgatctggaaagcctgcaagtgtgccttaggatcggttgtaccatcgtaaggagccactttgactttatcaggatccgaaaccgtagtttcggtgatgcgggtggtgaagggcgtttttcgagactcctcgaggagtagggtgatatcgagtgcagtactagtagcgtgatgatttgggatttcaccgctctaacctccgcagccgttttca

SEQ ID NO: 441 - DNA, 734 bp, artificial sequence
  ad58-6372-1-1  Left  border  flanking
ttttacagtgttagaagaagtggatgaagctgaaattgaattttcaaactcgttcagcttgactagaggtgggagagagtcaaagcctcccatcaagtaccaaaacatggaatagaagacagtccgagggagaggaaaccgtggccgacgaggccgtggctcctatcattaactagtgtctttcttactattaatggtttattaagtctcagcctttgttgtttcattggtttgagattcactcatacatgaaacttgtttcattccagcttttccaaactataagaatatttccaatcttatcttgtaatagtttaagttttaaattgaaagcccttagttcaaaaaacaaaaaaaaaaaattagcccttgaatttatatataatcacgacggccatatttggcagctacactgatatgttttcaattggctgacaggccttgagcagggtttgctgggtatattggtaggaagatgtgttgcgaggttgaagcctcatttaggcaatataaacatgatcattagcgttatgtcattagttatacttatacgtagactaagtaacccactaaaggttgctgattccttttgtatcgactaacacattgcggacgtttttaatgtactgaattaacgccgaattgaattcgagctcggtacccggggatcctctagagtcgacctgcaggcatgcaagcttagcttgagcttggatcagattgtcgtttcccgc

SEQ ID NO: 442 - DNA, 521 bp, artificial sequence
  ad58-6372-1-1  Right border  flanking
catgttcctttcagaggggactgtacttctgtagattactttccctcattaaccagatctggccggcctacccagctttcttgtacaaagtggtgataaactatcagtgtttgactgaattttaatttctaatttttgtaaaaaatttgtataacctcaaattattaaaaggcggattttattagaattataactaaattatctataactccaaaattttgacaatcaatcatgtctatatctttatttttttgctaaattatcatgtctatatcttttctttcttccaaacttacttgagactaaaagtctttataaattttgataggagttccacacacaaacaaaaacaaaacaaatatttttcatcaagggatacttatttaacatcacggattcacagtttattaacaaaaatccaaacaaagactgaaagacagaagattcaatctaacaatagtcggcaaacaccagtgattaactaacgaaataaattaacaagtggtcagatcttcgggaaa

SEQ ID NO: 443 - DNA, 450 bp, artificial sequence; identical to SEQ ID NO: 435
  ad58-6620-4-1 Left  border flanking

SEQ ID NO: 444 - DNA, 775 bp, artificial sequence
  ad58-6620-4-1 Right border  flanking
cataaccaccatctcaaacaatagaacttcctaagtgaagcaatgacttcaaatctacttgaaggcatggagtataagccatgttcctttcagaggggactgtacttctgtagattactttccctcattaaccagatctggccggcctacccagctttcttgtacaaagtggtgataaactatcagtgtttgaaataatcggatatttaattttcttagacagttcattagtagttgatcttaaacattcacgttttattttcttttcttttcgaatgctagactctagtttggtacccataggattcgagttacatgaagctattgacactgggagtgcttcaagatctgtaagaggcaaagattcacaaacagaacgtgatttcttggatagtgatgtggagattgtgataagaaccagcatgagtattacttttactgcccctgctgtggtgaagacatcaccaaaacagtcaagctcgtgaagaaatcagatattcaacccgcaaaaaaatctgacaatgcaaataaacctattgacactaagaatggttcaagatccgaagacaagaagacaaaaaatttgtcctggctccctgcttatctccagaagctgtttctttctgtttatggccacatcaaagacaaaggtaccctttcttttggtgcctttggtgtggacaggtgtgattgactttggtttcttggcagattcaggcaagatagaggttgattcaaagtcaactaacaatgatcttggtaccaatagtgagga

SEQ ID NO: 445 - DNA, 808 bp, artificial sequence
  ad58-6620-17-1 Left border  flanking
ccgccttgaacaaccgctccgccgttgctcagtacattatcgaggttaccaaaaagttcaatcctttatgcttgttttggcgtgtgattcgttacgaatgagtaaaattgatttggtttttttctttgaacagcatggtggagatgtgaatgcgacggatcatacggggcagactgcgttgcattggagtgcggttcgtggtgcggtgcaagttgcggagcttttgcttcaagagggtgcaagggttgatgctacggatatgtatggatatcaggttctaaccacttcctctttctttgtggagattgtctttttgtttcaatgctagtcaacttctttctttctttcacaaaactaagtagtattgcttgttttgttgtcgttgcattttttcttatggctgtgttctgaggttcatgtaggtatataagcacttcgtactttgccacttgtttcatttaggcaacattgtgcacatatctaagtagttggtctttgtaaaattagtttgtttgtcttcaaagtatattgagcagtttcatgactcattattcaaaggtttgtctaaattagagagaactttcattttgcctggatttaatcagcatttagaatgtttatagcgatatcatttttagttgaaaaaatctcaacaaattgacgcttagacaacttaataacacattgcggacgtttttaatgtactgaattaacgccgaattgaattcgagctcggtacccggggatcctctagagtcgacctgcaggcatgcaagcttagcttgagcttggatcagattgtcgtttc

SEQ ID NO: 446 - DNA, 578 bp, artificial sequence
  ad58-6620-17-1 Right border  flanking
gtataagccatgttcctttcagaggggactgtacttctgtagattactttccctcattaaccagatctggccggcctacccagctttcttgtacaaagtggtgataaactatcagtgttagatccccgaccgaccgcccatcctggacggcctcgtgcatgctgatgttgtcaaaatcttaggatccaatgagtttatcaggtatacttctatcatgtattgcttgagattttggagtgttagtaaagatttcaataaaagaattttttcaaacaaaattttgggggcttgaagctaatgtttggaaatatgtaacggagtttaaatcttttggcaggcctatatatgcgggaaacgccttgtgtagagttcgctatactggtgctggtccttgtgtgttgactattagaactacatcttttcctgttaccccaataactgagtcaaagaaagctactatctctcagattgatctctcgaaattcaaagaaggtttgtttagtattattctcttgtgcatagcctttttgstttttttttttttataaaaaaagttgagtatgcttattgcccattgc

SEQ ID NO: 447 - DNA, 24 bp, artificial sequence
  primer sequence
cttacatgcttaggatcggacttg

SEQ ID NO: 448 - DNA, 22 bp, artificial sequence
  primer
agttccagcaccagatctaacg

SEQ ID NO: 449 - DNA, 24 bp, artificial sequence
  primer
ccctgagcccaagcagcatcatcg

SEQ ID NO: 450 - DNA, 18 bp, artificial sequence
  primer
cggagagggcgtggaagg

SEQ ID NO: 451 - DNA, 22 bp, artificial sequence
  primer
ttcgatttgctacagcgtcaac

SEQ ID NO: 452 - DNA, 22 bp, artificial sequence
  primer
aggcaccatcgcaggcttcgct

SEQ ID NO: 453 - DNA, 22 bp, artificial sequence
  primer
cttccactccttcctcctcgtc

SEQ ID NO: 454 - DNA, 21 bp, artificial sequence
  primer
gcgtcccaaagggttgttgag

SEQ ID NO: 455 - DNA, 22 bp, artificial sequence
  primer
tctctactgggcctgccagggc

SEQ ID NO: 456 - DNA, 28 bp, Artificial Sequence
  primer
ccccgagacgttgaaggctaagtacaaa

SEQ ID NO: 457 - DNA, 24 bp, artificial sequence
  primer
ttgcgctgacggattctacaagga

SEQ ID NO: 458 - DNA, 24 bp, artificial sequence
  primer
tccatcagtccaaacagcagcaga

SEQ ID NO: 459 - DNA, 23 bp, artificial sequence
  primer
catagcagtctcacgtcctggtc

SEQ ID NO: 460 - DNA, 26 bp, artificial sequence
  primer
ggaagctaagccattacactgttcag

SEQ ID NO: 461 - DNA, 23 bp, artificial sequence
  primer
catagcagtctcacgtcctggtc

SEQ ID NO: 462 - DNA, 20 bp, artificial sequence
  primer
cctgatccgttgacctgcag

SEQ ID NO: 463 - DNA, 20 bp, artificial sequence
  primer
gtgtgaggtggctaggcatc

SEQ ID NO: 464 - DNA, 26 bp, artificial sequence
  primer
ggaagctaagccattacactgttcag

SEQ ID NO: 465 - DNA, 22 bp, artificial sequence
  primer
agagaggagacagagagagagt

SEQ ID NO: 466 - DNA, 23 bp, artificial sequence
  primer
agacagcatcaagatttcacaca

SEQ ID NO: 467 - DNA, 21 bp, artificial sequence
  primer
caacggcgagcgtaatcttag

SEQ ID NO: 468 - DNA, 22 bp, artificial sequence
  primer
gttccctggaattgctgatagg

SEQ ID NO: 469 - DNA, 20 bp, artificial sequence
  primer
tgttggtggaagaggatacg

SEQ ID NO: 470 - DNA, 18 bp, artificial sequence
  primer
atcagcagcagcgatagc

SEQ ID NO: 471 - DNA, 118 bp, brassica napus
gacatcaagtggtacggcaagtacctcaacaacccgctaggacgcacggtgatgctaaccgtccagttcaagctcggctggccgttgtacttagccttcaacgtctcgggaagacctt

SEQ ID NO: 472 - DNA, 118 bp, brassica napus
gacatcaagtggtacggcaagtacctcaacaacccgctaggacgcacggtgatgctaaccgtccagttcacgctcggctggccgttgtacttagccttcaacgtctctggaagacctt

SEQ ID NO: 473 - DNA, 118 bp, brassica napus
gacatcaagtggtacggcaagtacctcaacaaccctttgggacgcacggtgatgttaacggttcagttcactctcggctggcctttgtacttagccttcaacgtctcgggaagacctt

SEQ ID NO: 474 - DNA, 118 bp, brassica napus
gacatcaagtggtacggcaagtacctcaacaaccctttgggacgcacggtgatgttaacggttcagttcactctcggctggccgttgtacttagccttcaacgtctcgggaagacctt

SEQ ID NO: 475 - DNA, 20 bp, brassica napus
cagacatcaagtggtacggc

SEQ ID NO: 476 - DNA, 28 bp, brassica napus
acggcaagtacctcaacaaccctttggg

SEQ ID NO: 477 - DNA, 28 bp, brassica napus
cgcaccgtgatgttaacggttcagttca

SEQ ID NO: 478 - DNA, 28 bp, brassica napus
cggcaagtacctcaacaaccctttggga

SEQ ID NO: 479 - DNA, 28 bp, brassica napus
accgtgatgttaacggttcagttcactc

SEQ ID NO: 480 - DNA, 20 bp, brassica napus
cttagcttcaacgtctcggg

What may be claimed is:

1. A method for producing a transgenic plant cell, the method comprising:
    transforming a plant cell with a donor nucleic acid molecule and a nucleic acid molecule encoding a site-specific nuclease, which is a fusion protein comprising a cleavage domain and a DNA binding domain selected form the group consisting of: a meganuclease DNA-binding domain, a leucine zipper DNA-binding domain, a transcription activator-like (TAL) DNA-binding domain, a DNA-binding domain from a recombinase, a zinc finger protein DNA-binding domain, and chimeric combinations thereof, wherein the plant cell comprises a polynucleotide integrated at a locus in the genomic DNA of the plant cell, the polynucleotide comprising, in the 5' to 3' direction:
    a first promoter,
    a first, non-functional fragment of a first, functional marker gene,
    at least one recognition site for the site-specific nuclease, and
    a second, non-functional fragment of a second, functional marker gene, wherein the first promoter is operably-linked to the first, non-functional fragment of the first, functional marker gene, and wherein the first, functional marker gene encodes a different marker from the marker encoded by the second, functional marker gene,
    wherein the donor nucleic acid molecule comprises a donor polynucleotide comprising, in the 5' to 3' direction, a second fragment of the first, functional marker gene, a nucleotide sequence of interest, a second promoter, and a first fragment of the second, functional marker gene, wherein the second promoter is operably-linked to the first fragment of the second, functional marker gene,
    thereby expressing the site-specific nuclease to introduce a double-strand break into the genomic DNA of the plant cell at the recognition site of the site-specific nuclease, such that repair of the double-strand break results in integration of the donor polynucleotide at the locus to produce the transgenic plant cell,
    wherein the transgenic plant cell comprises at the locus, in the 5' to 3' direction:
    the first promoter,
    the first, functional marker gene,
    the nucleotide sequence of interest,
    the second promoter, and the second, functional marker gene, wherein the first promoter is operably-linked to the first, functional marker gene, and wherein the second promoter is operably-linked to the second, functional marker gene.

2. The method of claim 1, wherein the polynucleotide integrated at the locus in the genomic DNA of the plant cell comprises, in the 5' to 3' direction:
    the first fragment of the first marker gene,
    a first homology arm nucleotide sequence,
    at least one recognition site for the site-specific nuclease,
    a second homology arm nucleotide sequence, and
    the second fragment of the second marker gene,
    wherein the donor polynucleotide comprises, in the 5' to 3' direction:
    the first homology arm nucleotide sequence,
    the second fragment of the first marker gene,
    the nucleotide sequence of interest,
    the first fragment of the second marker gene, and
    the second homology arm nucleotide sequence,
    such that the donor polynucleotide is integrated at the locus by a homology-dependent double-strand break repair mechanism.

3. The method of claim 2, wherein the first or second homology arm nucleotide sequence is an intron.

4. The method of claim 2, wherein the first and second homology arm nucleotide sequences share less than 50% sequence identity.

5. The method of claim 2, wherein the first and second homology arm nucleotide sequences are from 50 bp to 3 kbp in length.

6. The method of claim 1, wherein the plant cell is comprised in a plant tissue or a whole plant.

7. The method of claim 1, wherein the nucleotide sequence of interest comprises a gene expression cassette.

8. The method of claim 7, wherein the gene expression cassette comprises at least one transgene.

9. The method of claim 8, wherein the transgene is selected from the group consisting of an insect resistance transgene, an herbicide tolerance transgene, a nitrogen use efficiency transgene, a water use efficiency transgene, a nutritional quality transgene, a transgene encoding a DNA-binding protein, and a transgene encoding a selectable marker.

10. The method of claim 1, wherein the cleavage domain or cleavage half-domain is selected from the group consisting of a cleavage half-domain from a type IIS restriction site specific nuclease, a cleavage half-domain from a FokI site-specific nuclease, a cleavage half-domain from a StsI site-specific nuclease, and a homing site-specific nuclease.

11. The method of claim 1, wherein the DNA-binding domain is a zinc finger DNA-binding domain.

12. The method of claim 11, wherein the cleavage domain or cleavage half-domain is selected from the group consisting of a cleavage half-domain from a type IIS restriction site specific nuclease, a cleavage half-domain from a FokI site-specific nuclease, and a cleavage half-domain from a StsI site-specific nuclease.

13. The method of claim 1, further comprising screening for expression of the first, functional marker gene or screening for expression of the second, functional marker gene in the transgenic plant cell.

14. The method of claim 1, further comprising screening for expression of the first, functional marker gene and the second, functional marker gene.

15. The method of claim 1, wherein the first, functional marker gene or second, functional marker gene is selected from the group consisting of PMI, YFP, Xyl(A), RFP, DSR, GFP, GUS, NPTII, AAD-1, AAD-12, AHAS, PAT, HPH, and BAR.

16. The method of claim 1, further comprising isolating the transgenic plant cell utilizing flow cytometry.

17. The method of claim 2, wherein the first and second homology arm nucleotide sequence are introns.

18. The method of claim 1, further comprising regenerating a transgenic plant tissue or transgenic plant from the transgenic plant cell.

19. The method of claim 1, wherein the screening utilizes fluorescence-activated cell sorting (FACS).

20. A method for producing a transgenic plant cell, the method comprising:
transforming a plant cell with a donor nucleic acid molecule and a nucleic acid molecule encoding a site-specific nuclease, which is a fusion protein comprising a cleavage domain and a DNA binding domain selected form the group consisting of: a meganuclease DNA-binding domain, a leucine zipper DNA-binding domain, a transcription activator-like (TAL) DNA-binding domain, a DNA-binding domain from a recombinase, a zinc finger protein DNA-binding domain, and chimeric combinations thereof, wherein the plant cell comprises a polynucleotide integrated at a locus in the genomic DNA of the plant cell, the polynucleotide comprising, in the 5' to 3' direction:
a first incomplete expression cassette consisting of, in the 5' to 3' direction:
a first promoter,
a first, non-functional fragment of a first, functional marker gene operably linked to the first promoter,
a first homology arm nucleotide sequence, and
a 3' untranslated region, at least one recognition site for the site-specific nuclease, and
a second incomplete expression cassette consisting of, in the 5' to 3' direction:
a second homology arm nucleotide sequence,
a second, non-functional fragment of a second, different functional marker gene, and a 3' untranslated region,
wherein the donor nucleic acid molecule comprises a donor polynucleotide comprising, in the 5' to 3' direction:
a third incomplete expression cassette consisting of, in the 5' to 3' direction:
the first homology arm nucleotide sequence,
a second fragment of the first, functional marker gene,
a 3' untranslated region,
a nucleotide sequence of interest,
and a fourth incomplete expression cassette consisting of, in the 5' to 3' direction:
a second promoter,
a first fragment of the second, functional marker gene operably linked to the second promoter,
and the second homology arm nucleotide sequence,
thereby expressing the site-specific nuclease to introduce a double-strand break into the genomic DNA of the plant cell at the recognition site of the site-specific nuclease, such that repair of the double-strand break results in integration of the donor polynucleotide at the locus to produce the transgenic plant cell,
wherein the transgenic plant cell comprises at the locus, in the 5' to 3' direction: the first promoter,
the first, functional marker gene containing the first homology arm nucleotide sequence,
the nucleotide sequence of interest,
the second promoter, and
the second, functional marker gene containing the second homology arm,
wherein the first promoter is operably-linked to the first, functional marker gene, and wherein the second promoter is operably-linked to the second, functional marker gene.

21. The method of claim 20, wherein the first homology arm nucleotide sequence and the second homology arm nucleotide sequence are introns.

22. The method of claim 20, wherein the nucleotide sequence of interest is a transgene expression cassette.

23. The method of claim 20, wherein the nucleotide sequence of interest is a recognition site for a further site-specific nuclease.

24. The method of claim 3, wherein the polynucleotide integrated at the locus in the genomic DNA of the plant cell comprises, in the 5' to 3' direction:
(i) a first expression cassette consisting of:
the first promoter,
the first, non-functional fragment of the first, functional marker gene operably linked to the first promoter,
a first intron, and
a 3' untranslated sequence comprising a transcriptional terminator;
(ii) at least one recognition site for the site-specific nuclease; and
(iii) a second, incomplete expression cassette consisting of:
a second intron,
the second, non-functional fragment of the second, functional marker gene, and
a 3' untranslated sequence comprising a transcriptional terminator.

25. The method of claim 24, wherein the donor polynucleotide comprises, in the 5' to 3' direction:
(i) a first, incomplete expression cassette consisting of:
the first intron,
the second fragment of the first, functional marker gene, and
a 3' untranslated sequence comprising a transcriptional terminator;
(ii) the nucleotide sequence of interest; and
(iii) a second, incomplete expression cassette consisting of:
the second promoter,
the first fragment of the second, functional marker gene operably linked to the second promoter, and
the second intron.

26. The method of claim 25, wherein the nucleotide sequence of interest comprises a transgene expression cassette.

27. The method of claim 26, wherein the polynucleotide integrated at the locus in the genomic DNA of the plant cell comprises a recognition site for a further site-specific nuclease 5' with respect to the first, incomplete expression cassette, and wherein the donor polynucleotide comprises a recognition site for the further site-specific nuclease 5' with respect to the nucleotide sequence of interest.

* * * * *